US008975068B2

(12) United States Patent
Lee

(10) Patent No.: US 8,975,068 B2
(45) Date of Patent: Mar. 10, 2015

(54) ISOLATED STEM CELL COMPRISING A XIC FLANKING REGION TRANSGENE

(75) Inventor: Jeannie T. Lee, Weston, MA (US)

(73) Assignee: The General Hospital Corporation, Boston, MA (US)

( * ) Notice: Subject to any disclaimer, the term of this patent is extended or adjusted under 35 U.S.C. 154(b) by 1411 days.

(21) Appl. No.: 12/523,018

(22) PCT Filed: Jan. 24, 2008

(86) PCT No.: PCT/US2008/000959
§ 371 (c)(1),
(2), (4) Date: Feb. 16, 2010

(87) PCT Pub. No.: WO2008/091680
PCT Pub. Date: Jul. 31, 2008

(65) Prior Publication Data
US 2010/0203632 A1    Aug. 12, 2010

Related U.S. Application Data

(60) Provisional application No. 60/897,399, filed on Jan. 25, 2007.

(51) Int. Cl.
| | |
|---|---|
| C12N 5/00 | (2006.01) |
| C12N 5/0735 | (2010.01) |
| C12N 15/90 | (2006.01) |
| C12N 15/86 | (2006.01) |
| C12N 15/113 | (2010.01) |
| C12N 15/63 | (2006.01) |
| C12N 5/16 | (2006.01) |
| C12N 15/85 | (2006.01) |
| C12N 15/11 | (2006.01) |

(52) U.S. Cl.
CPC .......... *C12N 5/0606* (2013.01); *C12N 2330/10* (2013.01); *C12N 15/907* (2013.01); *C12N 2510/00* (2013.01); *C12N 15/86* (2013.01); *C12N 15/113* (2013.01); *C12N 15/63* (2013.01); *C12N 2501/065* (2013.01); *C12N 5/16* (2013.01); *C12N 15/85* (2013.01); *C12N 15/11* (2013.01); *C12N 2501/40* (2013.01); *C12N 2501/60* (2013.01)
USPC ........... 435/325; 435/352; 435/354; 435/357; 435/363; 435/366

(58) Field of Classification Search
CPC .. C12N 15/85; C12N 2330/10; C12N 15/113; C12N 15/86; C12N 15/907; C12N 2501/40; C12N 2510/00; C12N 5/0606; C12N 15/11; C12N 15/63; C12N 2501/065; C12N 5/16
See application file for complete search history.

(56) References Cited

U.S. PATENT DOCUMENTS

| | | | |
|---|---|---|---|
| 4,959,317 | A | 9/1990 | Sauer |
| 5,527,695 | A | 6/1996 | Hodges et al. |
| 6,632,672 | B2 | 10/2003 | Calos |
| 6,734,295 | B1 | 5/2004 | Miyagawa et al. |
| 7,297,539 | B2 | 11/2007 | Mandalam et al. |
| 7,455,983 | B2 | 11/2008 | Xu et al. |
| 7,459,547 | B2 | 12/2008 | Zamore et al. |
| 2004/0203145 | A1 | 10/2004 | Zamore et al. |
| 2004/0235159 | A1 | 11/2004 | Mandalam et al. |
| 2005/0037492 | A1 | 2/2005 | Xu et al. |
| 2005/0037988 | A1 | 2/2005 | Zamore et al. |
| 2005/0059892 | A1 | 3/2005 | Dubois et al. |
| 2005/0153918 | A1 | 7/2005 | Chabot et al. |
| 2006/0058255 | A1 | 3/2006 | Chen et al. |
| 2006/0134787 | A1 | 6/2006 | Zamore et al. |
| 2009/0215872 | A1 | 8/2009 | Lee |

FOREIGN PATENT DOCUMENTS

| | | |
|---|---|---|
| WO | WO 01/51616 | 7/2001 |
| WO | WO 01/75164 | 10/2001 |
| WO | WO 2007/053207 | 5/2007 |

OTHER PUBLICATIONS

Heard, et al., "Transgenic mice carrying Xist-containing YAC," *Hum. Mol. Genetics*, 5:441-450 (1996).
Office Action for U.S. Appl. No. 11/988,321, dated Jun. 8, 2012.
Amit et al., "Feeder layer- and serum-free culture of human embryonic stem cells," *Biol. Reprod.* 70:837-845 (2004).
Aravin et al., "A novel class of small RNAs bind to MILI protein in mouse testes," *Nature* 442:203-207 (2006).
Avner et al., "Molecular correlates of the murine Xce locus," *Genet. Res.* 72:217-224 (1998).
Avner et al., "X-chromosome inactivation: counting, choice and initiation," *Nat. Rev. Genet.* 2:59-67 (2001).
Baharvand et al., "Culture condition difference for establishment of new embryonic stem cell lines from the C57BL/6 and BALB/c mouse strains," *In Vitro Cell. Dev. Biol. Anim.* 40:76-81 (2004).
Bejerano et al., "A distal enhancer and an ultraconserved exon are derived from a novel retroposon," *Nature* 441:87-90 (2006).
Bell et al., "Methylation of a CTCF-dependent boundary controls imprinted expression of the Igf2 gene," *Nature* 405:482-485 (2000).
Bénit et al., "Cloning of a new murine endogenous retrovirus, MuERV-L, with strong similarity to the human HERV-L element and with a gag coding sequence closely related to the Fv1 restriction gene," *J. Virol.* 71:5652-5657 (1997).

(Continued)

*Primary Examiner* — Deborah Crouch
(74) *Attorney, Agent, or Firm* — Clark & Elbing LLP

(57) ABSTRACT

Disclosed herein are methods for controlling stem cell differentiation through the introduction of transgenes having Xic, Tsix, Xite, or Xic flanking region sequences to block differentiation and the removal of the transgenes to allow differentiation. Also disclosed are small RNA molecules and methods for using the small RNA molecules to control stem cell differentiation. Also disclosed are stem cells genetically modified by the introduction of Xic, Tsix, XUe, or Xic flanking region sequences.

12 Claims, 105 Drawing Sheets

(56) References Cited

OTHER PUBLICATIONS

Bénit et al., "ERV-L elements: a family of endogenous retrovirus-like elements active throughout the evolution of mammals," *J. Virol.* 73:3301-3308 (1999).
Bois et al., "A novel unstable mouse VNTR family expanded from SINE B1 elements," *Genomics* 49:122-128 (1998).
Bois et al., "Length of uninterrupted repeats determines instability at the unstable mouse expanded simple tandem repeat family MMS10 derived from independent SINE B1 elements," *Mamm. Genome* 12:104-111 (2001).
Borsani et al., "Characterization of a murine gene expressed from the inactive X chromosome," *Nature* 351:325-329 (1991).
Boumil et al., "Differential methylation of Xite and CTCF sites in Tsix mirrors the pattern of X-inactivation choice in mice," *Mol. Cell Bio.* 26:2109-2117 (2006).
Branda et al., "Talking about a revolution: The impact of site-specific recombinases on genetic analyses in mice," *Dev. Cell* 6:7-28 (2004).
Bradenberger et al., "MPSS profiling of human embryonic stem cells," *BMC Dev. Bio.* 4:10 (2004).
Brockdorff et al., "Conservation of position and exclusive expression of mouse Xist from the inactive X chromosome," *Nature* 351:329-331 (1991).
Brockdorff et al., "The product of the mouse Xist gene is a 15 kb inactive X-specific transcript containing no conserved ORF and located in the nucleus," *Cell* 71:515-526 (1992).
Brook et al., "The origin and efficient derivation of embryonic stem cells in the mouse," *Proc. Natl. Acad. Sci. USA* 94:5709-12 (1997).
Brown et al., "A gene from the region of the human X inactivation centre is expressed exclusively from the inactive X chromosome," *Nature* 349:38-44 (1991).
Brown et al., "The human XIST gene: analysis of a 17 kb inactive X-specific RNA that contains conserved repeats and is highly localized within the nucleus," *Cell* 71:527-542 (1992).
Cam et al., "Comprehensive analysis of heterochromatin- and RNAi-mediated epigenetic control of the fission yeast genome," *Nat. Genet.* 37:809-819 (2005).
Chao et al., "CTCF, a candidate trans-acting factor for X-inactivation choice," *Science* 295:345-347 (2002).
Chow et al., "Characterization of expression at the human XIST locus in somatic, embryonal carcinoma, and transgenic cell lines," *Genomics* 82:309-322 (2003).
Chureau et al., "Comparative sequence analysis of the X-inactivation center region in mouse, human, and bovine," *Genome Res.* 12:894-908 (2002).
Clemson et al., "XIST RNA paints the inactive X chromosome at interphase: evidence for a novel RNA involved in nuclear/chromosome structure," *J. Cell Biol.* 132:259-75 (1996).
Clemson et al., "Stabilization and localization of Xist RNA are controlled by separate mechanisms and are not sufficient for X inactivation," *J. Cell Biol.* 142:13-23 (1998).
Clerc et al., "Role of the region 3' to Xist exon 6 in the counting process of X-chromosome inactivation," *Nat. Genet.* 19:249-253 (1998).
Cohen et al., "The DXPas34 repeat regulates random and imprinted X inactivation," *Dev. Cell* 12:57-71 (2007).
Courtier et al., "Xce haplotypes show modified methylation in a region of the active X chromosome lying 3' to Xist," *Proc. Natl. Acad. Sci. USA* 92:3531-3535 (1995).
Debrand et al., "Functional analysis of the DXPas34 locus, a 3' regulator of Xist expression," *Mol. Cell Biol.* 19:8513-8525 (1999).
Dekker et al., "Capturing chromosome conformation," *Science* 295:1306-1311 (2002).
Donohoe et al., "Identification of a Ctcf cofactor, Yy1, for the X chromosome binary switch," *Mol. Cell* 25:43-56 (2007).
Elbashir et al., "Duplexes of 21-nucleotide RNAs mediate RNA interference in cultured mammalian cells," *Nature* 411:494-498 (2001).
Elbashir et al., "RNA interference is mediated by 21- and 22-nucleotide RNAs," *Genes Dev.* 15:188-200 (2001).
Ferrigno et al., "Transposable B2 SINE elements can provide mobile RNA polymerase II promoters," *Nat. Genet.* 28:77-81 (2001).
Gerasimova et al., "Boundary and insulator elements in chromosomes," *Curr. Opin. Genet. Dev.* 6:185-192 (1996).
Ghosh et al., "Cre-loxP biochemistry," *Methods* 28:374-383 (2002).
Girard et al., "A germline-specific class of small RNAs binds mammalian Piwi proteins," *Nature* 442:199-202 (2006).
Gorman et al., "The Igκ 3' enhancer influences the ratio of Igκ versus Igλ B lymphocytes," *Immunity* 5:241-252 (1996).
Grivna et al., "A novel class of small RNAs in mouse spermatogenic cells," *Genes Dev.* 20:1709-1714 (2006).
Gu et al., "Independent control of immunoglobulin switch recombination at individual switch regions evidenced through Cre-loxP-mediated gene targeting," *Cell* 73:1155-1164 (1993).
Hark et al., "CTCF mediates methylation-sensitive enhancer-blocking activity at the H19/Igf2 locus," *Nature* 405:486-489 (2001).
Havecker et al., "The diversity of LTR retrotransposons," *Genome Biol.* 5:225 (2004).
Heard, "Delving into the diversity of facultative heterochromatin: the epigenetics of the inactive X chromosome," *Curr. Opin. Genet. Dev.* 15:482-489 (2005).
Jacobs et al., "Late replicating X chromosomes in human triploidy," *Am. J. Hum. Genet.* 31:446-457 (1979).
Jones et al., "Human embryonic stem cell technology," *Semin. Reprod. Med.* 18:219-223 (2000).
Jurka et al., "Repbase Update, a database of eukaryotic repetitive elements," *Cytogenetics and Genome Res.* 110:462-467 (2005).
Kazazian, "Mobile elements: drivers of genome evolution," *Science* 303:1626-1632 (2004).
Kilby et al, "Site-specific recombinases: tools for genome engineering," *Trends Genet.* 9:413-421 (1993).
Kreahling et al., "The origins and implications of Aluternative splicing," *Trends Genet.* 20:1-4 (2004).
Lander et al., "Initial sequencing and analysis of the human genome," *Nature* 409:860-921 (2001).
LaSalle et al., "Homologous association of oppositely imprinted chromosomal domains," *Science* 272:725-728 (1996).
Lau et al., "Characterization of the piRNA complex from rat testes," *Science* 313:363-367 (2006).
Lee, "Homozygous Tsix mutant mice reveal a sex-ratio distortion and revert to random X-inactivation," *Nat. Genet.* 32:195-200 (2002).
Lee, "Regulation of X-chromosome counting by Tsix and Xite sequences," *Science* 309:768-771 (2005).
Lee et al., "Tsix, a gene antisense to Xist at the X-inactivation centre," *Nat. Genet.* 21:400-404 (1999).
Lee et al., "Targeted mutagenesis of Tsix leads to nonrandom inactivation," *Cell* 99:47-57 (1999).
Lee et al., "Genetic analysis of the mouse X inactivation center defines an 80-kb multifunction domain," *Proc. Natl. Acad. Sci. USA* 96:3836-3841 (1999).
Lee, "Disruption of imprinted X inactivation by parent-of-origin effects at Tsix," *Cell* 103:17-27 (2000).
Li et al., "Targeted mutation of the DNA methyltransferase gene results in embryonic lethality," *Cell* 69:915-926 (1992).
Lippman et al., "Role of transposable elements in heterochromatin and epigenetic control," *Nature* 430:471-476 (2004).
Luikenhuis et al., "Antisense transcription through the Xist locus mediates Tsix function in embryonic stem cells," *Mol. Cell. Biol.* 21:8512-8520 (2001).
Lyon, "Gene action in the X-chromosome of the mouse (*Mus musculus* L.)," *Nature* 190:372-373 (1961).
Marahrens et al., "Xist-deficient mice are defective in dosage compensation but not spermatogenesis," *Genes Dev.* 11(2);156-166 (1997).
Marahrens, "X-inactivation by chromosomal pairing events," *Genes Dev.* 13:2624-2632 (1999).
Marshall et al., "Isolation and maintenance of primate embryonic stem cells," *Methods Mol. Biol.* 158:11-18 (2001).
McBurney et al., "The mouse Pgk-I gene promoter contains an upstream activator sequence," *Nucleic Acids Res.* 19(20):5755-5761 (1991).
McCaffrey et al., "RNA interference in adult mice," *Nature* 418:38-39 (2002).

(56) References Cited

OTHER PUBLICATIONS

Meyers et al., "An Fgf8 mutant allelic series generated by Cre- and Flp-mediated recombination," *Nat. Genet.* 18:136-141 (1998).
Migeon et al., "Identification of TSIX, encoding an RNA antisense to human XIST, reveals differences from its murine counterpart: implications for X inactivation," *Am. J. Hum. Genet.* 69(5):951-960 (2001).
Monk et al., "Sequential X chromosome inactivation coupled with cellular differentiation in early mouse embryos," *Nature* 281:311-313 (1979).
Morey et al., "Tsix-mediated repression of Xist accumulation is not sufficient for normal random X inactivation," *Hum. Mol. Genet.* 10:1403-1411 (2001).
Morey et al., "The region 3' to Xist mediates X chromosome counting and H3 Lys-4 dimethylation within the Xist gene," *EMBO J.* 23(3):594-604 (2004).
Morgan et al., "Epigenetic inheritance at the agouti locus in the mouse," *Nat. Genet.* 23:314-318 (1999).
The National Institutes of Health, Department of Health and Human Services, "Stem Cells: Scientific Progress and Future Research Directions," Chapter 11, Appendix C, Appendix D, and Appendix E (2001).
Nesterova et al., "Loss of Xist imprinting in diploid parthenogenetic preimplantation embryos," *Dev. Biol.* 235:343-350 (2001).
Noma et al., "RITS acts in cis to promote RNA interference-mediated transcriptional and post-transcriptional silencing," *Nat. Genet* 36:1174-1180 (2004).
Odorico et al., "Multilineage differentiation from human embryonic stem cell lines," *Stem Cells* 19:193-204 (2001).
Oei et al., "Clusters of regulatory signals for RNA polymerase II transcription associated with Alu family repeats and CpG islands in human promoters," *Genomics* 83:873-882 (2004).
Ogawa et al., "Xite, X-inactivation intergenic transcription elements that regulate the probability of choice," *Mol. Cell* 11:731-743 (2003).
Paddison et al., "Short hairpin RNAs (shRNAs) induce sequence-specific silencing in mammalian cells," *Genes Dev.* 16:948-958 (2002).
Peaston et al., "Retrotransposons regulate host genes in mouse oocytes and preimplantation embryos," *Dev. Cell* 7:597-606 (2004).
Penny et al., "Requirements for Xist in X chromosome inactivation," *Nature* 379:131-137 (1996).
Pfeifer et al., "Delivery of the Cre recombinase by a self-deleting lentiviral vector: efficient gene targeting in vivo," *Proc. Natl. Acad. Sci. USA* 98:11450-11455 (2001).
Rastan, "Non-random X-chromosome inactivation in mouse X-autosome translocation embryos—location of the inactivation centre," *J. Embryol. exp. Morphol.* 78:1-22 (1983).
Rastan, "X-chromosome deletions in embryo-derived (EK) cell lines associated with lack of X-chromosome inactivation," *J. Embryol. exp. Morphol.* 90:379-388 (1985).
Sado et al., "X inactivation in the mouse embryo deficient for Dnmt1: distinct effect of hypomethylation on imprinted and random X inactivation," *Dev. Biol.* 225:294-303 (2000).
Sado et al., "Regulation of imprinted X-chromosome inactivation in mice by Tsix," *Development* 128:1275-1286 (2001).
SanMiguel et al., "Nested retrotransposons in the intergenic regions of the maize genome," *Science* 274:765-768 (1996).
Sauer et al., "Cre/lox: one more step in the taming of the genome," *Endocrine* 19:221-227 (2002).
Seitz et al., "Imprinted microRNA genes transcribed antisense to a reciprocally imprinted retrotransposon-like gene," *Nat. Genet.* 34:261-262 (2003).
Shibata et al., "Characterization and quantitation of differential Tsix transcripts: implications for Tsix function," *Hum. Mol. Genet.* 12(2):125-136 (2003).
Shibata et al., "Tsix transcription- versus RNA-based mechanisms in Xist repression and epigenetic choice," *Curr. Biol.* 14:1747-1754 (2004).
Shufaro et al., "Therapeutic applications of embryonic stem cells," *Best Pract. Res. Clin. Obstet. Gynaecol.* 18:909-927 (2004).
Simmler et al., "Mapping the murine Xce locus with $(CA)_N$ repeats," *Mamm. Genome* 4:523-530 (1993).
Simmler et al., "94 kb genomic sequence 3' to the murine Xist gene reveals an AT rich region containing a new testis specific gene Tsx," *Hum. Mol. Genet.* 5(11):1713-1726 (1996).
Sleutels et al., "The origins of genomic imprinting in mammals," *Homology Effects*, Ed. Dunlap and Wu, San Diego:Academic Press, 119-163 (2002).
Spilianakis et al., "Interchromosomal associations between alternatively expressed loci," *Nature* 435:637-645 (2005).
Stavropoulos et al., "A functional role for Tsix transcription in blocking Xist RNA accumulation but not in X-chromosome choice," *Proc. Natl. Acad. Sci. USA* 98:10232-10237 (2001).
Stavropoulos et al., "Identification of developmentally specific enhancers for Tsix in the regulation of X chromosome inactivation," *Mol. Cell Biol.* 25:2757-2769 (2005).
Sutherland et al., "An upstream activator sequence regulates the murine Pgk-1 promoter and binds multiple nuclear proteins," *Gene Expr.* 4:265-279 (1995).
Thomson et al., "Human embryonic stem cell and embryonic germ cell lines," *Trends Biotechnol.* 18:53-57 (2000).
Thomson et al., "Embryonic stem cell lines derived from human blastocysts," *Science* 282:1145-1147 (1998).
Volpe et al., "Regulation of heterochromatic silencing and histone H3 lysine-9 methylation by RNAi," *Science* 297:1833-1837 (2002).
Voss et al., "Germ line chimeras from female ES cells," *Exp. Cell Res.* 230:45-49 (1997).
Webb et al., "The differential staining pattern of the X chromosome in the embryonic and extraembryonic tissues of postimplantation homozygous tetraploid mouse embryos," *Genet. Res.* 59:205-14 (1992).
Willoughby et al., "An Alu element from the K18 gene confers position-independent expression in transgenic mice," *J. Biol. Chem.* 275:759-768 (2000).
Wutz et al., "A shift from reversible to irreversible X inactivation is triggered during ES cell differentiation," *Mol. Cell* 5:695-705 (2000).
Xu et al., "Feeder-free growth of undifferentiated human embryonic stem cells," *Nature Biotechnol.* 19:971-974 (2001).
Xu et al., "Transient homologous chromosome pairing marks the onset of X inactivation," *Science* 311:1149-1152 (2006).
Yu et al., "RNA Interference by expression of short-interfering RNAs and hairpin RNAs in mammalian cells," *Proc. Natl. Acad. Sci. USA* 99:6047-6052 (2002).
Zamore et al., "RNAi: Double-stranded RNA directs the ATP-dependent cleavage of mRNA at 21 to 23 nucleotide intervals," *Cell* 101:25-33 (2000).
International Search Report for International (PCT) Patent Application No. PCT/US2006/025800, mailed Aug. 14, 2008.
Written Opinion of the International Searching Authority for International (PCT) Patent Application No. PCT/US2006/025800, mailed Aug. 14, 2008.
International Preliminary Report on Patentability for International (PCT) Patent Application No. PCT/US2006/025800, issued May 12, 2009.
International Search Report for International (PCT) Patent Application No. PCT/US2008/000959, mailed Sep. 18, 2008.
Written Opinion of the International Searching Authority for International (PCT) Patent Application No. PCT/US2008/000959, mailed Sep. 18, 2008.
International Preliminary Report on Patentability for International (PCT) Patent Application No. PCT/US2008/000959, issued Jul. 28, 2009.

Regulatory elements of the X-inactivation center

DNA sequence 19470 bp ccggaccggacc ... ttcaaagtgatc linear

Positions of R. E. sites (sites unique in whole sequence are bold)

PROXIMAL END OF pSxn transgene

```
            ↓ Vpa K1 1AI
              Sau 96I
              Fmu I
             [RsrII
              Hpa II
              Bsl I                                          Cvi JI
              Bsa WI                                         Alu I
            Vpa K11AI                                        Ace III
            Sau 96I                                Tse I                                  Scr FI
            Fmu I     Bst DSI                      Fnu 4HI                                Eco RII
            Ava II    Bsa JI                Nla III                                       Bst NI
            Rsr II    Bst 4CI        Xcm I  RleAI  Bbv I                          Bsr I   Bss KI
            Hpa II Ava II       Tsp 509I  Msl I   CviAII         Bst 4CI          Bsl I   Bsa JI
            ||| ||||| ||          |        | |     |||             |                |       |
            ccggaccggaccgtggttgtggttcaattcccagcacccacatggcagctcacaactgtctgtaagtccagttccagggt  80
            ggcctggcctggcaccaacaccaagttaagggtcgtgggtgtaccgtcgagtgttgacagacattcaggtcaaggtccca
            ||| ||||| ||          •       • |     |||             |                |   •   •
            1 2       8  10          26    35  41           55                      68   74
             3         11           31   37    41  45                              68    74
             3         11                        45                                     74
             3                                   45                                     74
               5                                  46
                6                      Begin: most highly      47
                 7                            conserved region 47
                  8
                  8
                  8
              Mnl I                                        Cvi RI
                |                                            |
            atctgacaccctcatacagacttacattcaggcaaaacaccaatgcactaaataaatacatacatacacaccgaacaaca  160
            tagactgtgggagtatgtctgaatgtaagtccgttttgtggttacgtgatttatttatgtatgtatgtggcttgttgt
                |                                         |
               90                                       124
```

```
                                                                          Mbo I
                                                                          Dpn I
                                                                         Nla III
                                                                         Cvi AII
                                                   Scr FI                  Sty I
                                                   Eco RII                 Nco I
                                                   Bst NI                  Bst DSI
                                                   Bss KI                  Bsa JI
                                              Cac 8I    Mnl I       Vpa K11AI    Eco RI
                                              Cvi RI    Bpm I       Sau 96I      Cha I  Tsp 509I
              Sfc I          Bsr I   Bsr DI   Bsl I                 Fmu I      Bsp KT6I           Cvi JI
              Ahd I          Cvi JI  Mwo I    Cvi JI                Ava II    Alw I   Apo I  Cvi JI  |
              | |             | |     ||      || ||                  | |      ||     |•    |•|     |
            aaagactacaggtctgaaaaaagccagtaggcattgcaagcctggaggtggtggaccatggatcagaattcaaggctggg  240
            tttctgatgtccagacttttttcggtcatccgtaacgttcggacctccaccacctggtacctagtcttaagttccgaccc
              | |             | •     ••      •• ••                  • |      ••     |•    |•|     •
            164             182    191    199                      213    220   226    234      239
               166             184   192  201                       213    221   227
                                        195    202                   213         226
                                        196       205                213
                                                   201                  216
                                                   201                  216
                                                   201                  216
                                                   201                  216
                                                                        217
                                                                        217
                                                                          221
                                                                          221
```

```
        Sts I                                                                                                                                        
        Fok I                                           Mbo II                                                                                       
        Bst F5I                                         Bbs I                    Mnl I                 Cac 8I  Mse I                                 
agacaccatccacccatttgtctaaagtgagttagtcttcccaatcaaatcctcacttatgccaatgcctgccttaaatg 2560
tctgtggtaggtgggtaaacagatttcactcaatcagaagggttagtttaggagtgaatacggttacggacggaatttag
        2487                                            2515         2531                2547   2554
        2487                                            2516
        2487
                Mnl I
                Bse RI            Cje PI                                                        Sty I
            Bsm AI  Tsp 509I                                                 Tsp 509I       Bsa JI
ttttctatgtgtagtctcctcaattaccatcaacattcaaaccatcactttcccctataattccatttaccttggacttt 2640
aaaagatacacatcagaggagttaatggtagttgtaagtttggtagtgaaaggggatattaaggtaaatggaacctgaaa
                 2574    2582                                             2619        2630
                     2576      2587                                                   2630
                        2578
                                                                                            Vpa K11AI
                                                                                            Sau 96I
                                                                                            Fmu I
                                                                                            Ava II
                                                                                            Sse B647I
                                            Nla III                                         Pss I
        Cvi JI                              Cvi AII                                         Ppu MI
    Cje PI        Tsp 509I   Cvi JI                          Hinc II                        Eco 0109I
cacttccagccttattctaatttcttgggcttcatgtttattcgtcaactttcattttcattatacaaggacctgataa 2720
gtgaaggtcggaataagattaaagaacccgaaagtacaaataagcagttgaaagtaaaagtaatatgttcctggactatt
    2646             2659     2668                 2685                                    2709
        2648                           2674                                                 2709
                                       2674                                                 2709
                                                                                            2709
                                                                                            2710
                                                                                            2710
                                                                                            2710
                                                                                            2710
                                                    Fnu 4HI      Nla III
                                                    Aci I        Msl I
                                                Bsm I            Cvi AII            Mse I
                                            Tsp 509I  Cvi JI  Mnl I                 Dra I
gtttttattgataaaagttttattatttgctatgaattgaatgcggctatgccctcatgtgtgtgtgttttaaatagta 2800
caaaaataactattttcaaaataataaacgatacttaacttacgccgatacgggagtacacacacacaaatttatcat
                                            2755     2765   2773                    2790
                                               2759         2776                      2791
                                                      2763  2776
                                                      2763   Nla III 2776
    Dde I                                                    Cvi AII
    Bse MII                                                  Nsp I
    Cvi JI                                                   Bsp LU11I     Cvi JI
    Alu I             Mse I                                  Afl III      Bfa I             Alw NI
agctcagatgtttacttaaaaacaaaacaaaacaaaacaaaacaaaacatgtgttttctagccaagttggtcaggaact 2880
tcgagtctacaaatgaattttgttttgttttgttttgttttgttttgtacacaaaagatcggttcaaccagtccttga
    2801           2816                                      2848      2859        2873
    2801                                                     2848          2861
        2803                                                     2848
        2803                                                        2849
```

```
                Cvi JI
        Scr FI
        Eco RII
        Bst NI
        Bss KI
        Bsa JI    Mae III              Bsm AI
gttccaagacaccagggctgttacatagagaaatgctgtctcaaaaatgaacacacacacacacacacacacacacacac 3520
caaggttctgtggtcccgacaatgtatctctttacgacagagttttttacttgtgtgtgtgtgtgtgtgtgtgtgtgtg
        3452      3460         3478
        3452
        3452
        3452
        3452
            3456
                                        Rsa I
                          Tsp 509I      Tat I
                          Apo I         Bsr GI                          Tsp 509I
        Hin PlI           Taq I    Nde I                   Mse I        Tai I
        Hha I    Xmn I    Bst BI   Cvi RI   Csp 6I         Dra I        Mae II
acacacacaagcgcaagaaagaaaccattcgaatttgactgcatatgtacataaaacctttaaataaaagacgtaatttc 3600
tgtgtgtgttcgcgttctttctttggtaagcttaaactgacgtatacatgtattttggaaatttatttctgcattaaag
    3531     3541    3548   3560   3567         3579       3591
    3531            3549       3562              3580      3591
                       3551        3566                         3595
                       3552        3566
                                   3567
                                                              Cje PI
                                                    Cvi JI    Cvi JI
        Sml I                                       Tse I     Tse I
        Afl II     Cvi JI                  Hga I    Fnu 4HI   Fnu 4HI
        Mnl I Mse I Nla IV       Bsm AI    Bsl I    Bbv I     Bbv I
aaatcaaatgaggtcttaagaatggagcctaaacctgtctgtctcttttaccagacgcagggcagccagaaggcagccatt 3680
tttagtttactccagaattcttacctcggatttggacagacagagaaatggtctgcgtcccgtcggtcttccgtcggtaa
    3610   3616    3624        3641     3650        3661     3672
           3615        3626                  3653   3661     3672
           3615                                     3661        3674
                                                                3676
        Mbo II
        Bbs I                                               Sml I
        Scr FI                                              Mnl I
        Eco RII                                    Mwo I    Cvi JI
        Bst NI                                     Bfa I    Bce 83I
        Bss KI             Sim I    Mnl I          Mnl I Cvi JI  Alu I
cacaatccaggaagacaggaagggataacaccagacccaacctccatttagagaggtctagcctcttgagctatgacac 3760
gtgttaggtccttctgtccttccctattgtggtctgggttggaggtaaaatctctccagatcggagaactcgatactgtg
    3687                              3714    3721        3734  3741    3750
    3687                                                       3739   3746
    3687                                                         3742     3750
    3687                                                         3743
        3691                                                          3746
        3691
                                    Cvi JI
                                    Alu I
                           Tsp 509I  Mse I
actatttgttctctaactacccaaagttgtatttactatgctaattagctgattaagacattaggtaaaggtgttctac 3840
tgataaacaagagattgatgggtttcaacataaaatgatacgattaatcgactaattctgtaatccatttccacaagatg
                                  3804     3814
                                     3808
                                     3808
```

```
                    Tsp RI                                                                    Rsa I
       Sch I                                                                                  Csp 6I
       Ple I                                            Cvi RI                                Tat I
       Mly I                                   Tsp 509I                                       Sca I
       Hin fI   Tth 111II                      Apo I
tatattagtatatattctggggagtcagtgtttgtctgcctactaacacaggtaagaatttgcataggtattacaaaatcag  4400
atataatcatataagacccctcagtcacaaacagacggatgattgtgtccattcttaaacgtatccataatgttttagtc
          4340   4347                      4374                                  4399
          4340                              4375                                  4399
          4340                                 4379                                  4400
          4340                                                                       4400
              4344

Mwo I
                                                                 Fnu 4HI
                                                                 Aci I
              Mbo II                                 Nla III               Mse I
              Ear I                      Mse I       Cvi AII               Dra I
      Cvi RI  Mbo II  Tsp 509I   Ase I   Tth 111II          Cvi JI
tactttgcaaatctttcttctcttccgaattgaaaactgaacattaatccaaacatggcggcagaagccttt aaaatcgg  4480
atgaaacgtttagaaagaagagaaggcttaacttttgacttgtaattaggtttgtaccgccgtcttcggaaattttagcc
      4406    4416       4428        4443  4450             4466
              4420                       4444                   4470
              4421                           4454               4471
                                             4454
                                                4458
                                                4458
                                                4458
                                                         Tth 111I
           Bsl I                                         Bsm AI
           Bsm FI          Mwo I                         Bsa I           Dde I
      Bst 4CI  Eco 57I     Cac 8I   Cvi JI         Dde I             Bse MII
    Tsp RI  Tsp RI  Tsp RI          Alu I    Mnl I   Bse MII         Bsm AI
cactgtcccactgaaggcagtggcaggcagagctttgcgagtttgaggttatttactgagacccttgtctcagaaataagg  4560
gtgacagggtgacttccgtcaccgtccgtctcgaaacgctcaaactccaataaatgactctggaacagagtctttattcc
    4481  4489    4498        4511     4525        4536      4546
    4482  4491                4503     4511                  4536      4548
          4485                4503                                     4548
              4487                                                4538
                                                                  4538
                                                                  4538
                                                                    4540

Hph I      Sfa NI
                 Tsp 509I        Bcs AI            Cvi JI             Tsp 509I
    Mse I         Apo I           Aci I     Alu I    Mse I   Mnl I
cattaaaaaaaaaacaaaaacaaaattcaccccaaatccgcatcaaaaccaaagctgattgttaatttccctccttctcta  4640
gtaattttttttttgttttttgttttaagtggggtttaggcgtagttttggtttcgactaacaattaaagggaggaaagat
        4563              4583           4598       4613     4622   4630
                          4584           4600       4613     4624
                             4587         4600

Mnl I
                                                                Sth 132I
                                                                Scr FI
                                                                Ncl I
                                                                Hpa II
      Tfi I                                                     Eco HI
      Hin fI                                                                        Sfc I
    Bsr I   Dde I    Tth 111II       Tsp RI             Bss KI
aactggattcattccttagtgccattgtttgctcgtctgaacacactgaataaacactaccgggagggattttccgtgcc  4720
ttgacctaagtaaggaatcacggtaacaaacgagcagacttgtgtgacttatttgtgatggccctccctaaaaggcacgg
    4642    4655    4656        4684           4700                          4720
        4646                                    4700
        4646                                    4700
                                                4700
                                                4700
                                                  4701
                                                    4704
```

```
                            Sml I
         Aci I              Bce 83I
Tai I    Hph I     Tsp 509I            Mse I    Mse I
Mae II   Mnl I     Apo I  Cvi JI   Ssp I   Ssp I                                    Bss SI
acgtgcggtgaggtagtattgctgaatttggcttgagcaatattaaaatattaagactattccaaagagttttttcggaca 5280
tgcacgccactccatcataacgacttaaaccgaactcgttataattttataattctgataaggttttctcaaaaagcctgt
5201      5210          5224  5230      5239   5247                                 5279
  5201  5207             5225  5232         5243  5251
       5205                         5232

Bfa I
                                  Xba I                                         Bfa I
         Cvi JI               Tfi I                    Tsp 45I               Bsr BI  Xba I
         Mnl I                Hin fI   Sim I    Mae III    Mse I             Aci I  Sfc I Pst I
         cgaggctttccctgatgtgagtgtgtggattctagaccctgctacaagtcacgcccttaactttcttttccgctctagac 5360
         gctccgaaagggactacactcacacacctaagatctgggacgatgttcagtgcgggaattgaaagaaaaggcgagatctg
         5282                      5308   5315       5328       5337         5350     5360
            5284                   5308                5328                   5350  5354 5360
                                      5311                                         5355
                                      5312

Cvi JI
                                   Scr FI
                                   Eco RII
                                   Bst NI
Cvi RI        Bsl I   Bss KI            Cvi JI            Mae III   Cvi JI
tgcagtttattacccacgccaggcttattgaacgctttgcatatctacctgtaacattttagccaaccatctctacgcta 5440
acgtcaaataatgggtgcggtccgaataacttgcgaaacgtatagatggacattgtaaaatcggttggtagagatgcgat
5361         5373   5379              5398         5411       5421
                    5379
                    5379
                    5379
                       5382

Mnl I
                                                          Taq I
                                                          Sal I
              Mnl I                                       Hin cII
Cje RI        Hph I                 Drd I         Acc I    Bfa I       Psi I
tcccagacattttcatcacctctgctctgcccagcagacattttagtcgacctctaggggttggttataaggcagggatt 5520
agggtctgtaaaagtagtggagacgagacgggtcgtctgtaaaatcagctggagatccccaaccaatattccgtccctaa
5443           5456                  5477         5486     5494        5505
                   5459                              5486
                                                     5486
                                                     5487
                                                         5491
```

```
                                            Hpa I
                                            Bsl I
                                            Sth 132I
                                            Scr FI
                                            Nci I
                                            Eco HI
                                            Bss KI
                                    Mbo I
                                    Dpn I
                                    Cje PI
                                    Cha I
                                    Bsp KT6I
              Bfi I                 Alw I
        Mnl I                       Xcm I  Bsa JI         Msl I
Tsp 45I  Bsr I                      Mnl I  Bst YI         Cac 8I              Cvi JI
Mae III  Bsl I   Aci I  Cac 8I
ttagtgacctcccagtaagcggtggcaggcatttttagcgacctcccagatccccggtggcaggcattttagtgatagccc 6080
aatcactggagggtcattcgccaccgtccgtaaaatcgctggagggtctaggggccaccgtccgtaaaatcactatcggg
    6004    6012  6019  6025       6041 6047         6059                   6076
    6004    6012                   6045 6051         6064
          6008                          6048
          6011                          6048
                                        6048
                                        6048
                                        6048
                                        6048
                                        6048
                                  Hpa I 6052                              Sth 132I
                                  Bsl I 6052                              Bsm FI
                                  Sth 132I 6052                           Vpa K11AI
                                  Scr FI 6052                             Sau 96I
                                  Nci I 6053                              Nla IV
                                  Eco HI 6053                             Fmu I
                                  Bss KI                                  Ava II
                                  Mbo I                                   Pss I   Hpa II
        Taq I                     Dpn I                                   Ppu MI
        Mnl I                     Cje PI                                  Eco O109I
Mbo I                             Cha I                         Xcm I    Scr FI
Dpn I                             Bsp KT6I                      Scr FI   Nci I
Cha I                      Mnl I  Alw I                         Eco RII  Bsl I
Bsp KT6I                   Tsp 45I Bst YI            Msl I      Sex AI   Bsa JI
Alw I       Cac 8I         Mae III Xcm I Bsa JI   Cac 8I         Tsp 45I Bst NI   Eco HI
Bst YI  Bce fI  Mal I           Bst YI Bsa JI     Cac 8I         Mae III Bss KI   Bss KI
agatcctcgacggcaggcatttagtgacctcccagatccccggtggcaggcattttagtgacctaccaggtccccggtg 6160
tctaggagctgccgtccgtaaatcactggagggtctaggggccaccgtccgtaaaatcactggatggtccaggggccac
6081    6090  6098  6105  6113 6119   6127   6132    6139   6147  6154
        6082          6109      6115           6132  6139   6147  6154
        6082               6116                             6146  6153
        6082               6116                             6147  6155
        6082               6116                             6147  6154
        6082               6116                             6147  6154
             6085              6116                             6149
             6087              6116                             6149
                               6120                             6149  6155
                               6120                                   6150
                               6120                                   6150
                               6120                                   6150
                               6120                                   6150
                               6121                                   6151
                    Bst DSI  6121                                     6154
                    Bsa JI         Bfi I
    Msl I       Xcm I  Sth 132I    Mnl I
Cac 8I      Cvi JI  Bsm FI      Msl I  Mae III  Bsl I  Aci I  Cac 8I
gcaggcatttagtgatagcccaagtccccgtggcagacatttagtgacctcccagtaagcggtggcaggcattttag 6240
cgtccgtaaaatcactatcgggttcaggggcaccgtctgtaaaatcactggagggtcattcgccaccgtccgtaaaatc
6161                 6178  6185          6200   6207   6215  6222  6228
    6166                6181  6189              6207   6215
                              6190                   6211
                              6190                        6214
```

```
                                     Hpa I
                                     Bsl I
                                     Sth 132I
                                     Scr FI                              Bst DSI
                                     Nci I                          Rsa I Bsa JI
                        Cje PI                                           Sth 132I
              Xcm I     Eco HI       Msl I              Xcm I   Csp 6I                    Tsp 45I
     Msl I    Cvi JI    Bss KI       Cac 8I             Cvi JI                   Msl I    Mae III
     ggcatttagtgatagcccagataccggtggcaggcatttagtgatagcccaagtaccccgtggcagacatttagtg 6480
     ccgtaaaatcactatcgggtctatgggccaccgtccgtaaaatcactatcgggttcatggggcaccgtctgtaaaatcac
     6403          6415    6425  6432         6449  6456               6471   6478
                      6418  6425     6437      6452    6460                    6478
                          6421                                6456  6461
                              6425                                   6461
                              6425
                              6425
                              6426
                              6426

Sth 132I
                                                   Vpa K11AI
                                                   Sau 96I
                                                   Nla IV
                                                   Fmu I
                                                   Ava II
                                                   Pss I  Hpa II
                                                   Ppu MI
                                                   Eco O109I
                 Hpa I                             Xcm I   Scr FI
                 Bsl I                             Scr FI  Nci I
                 Sth 132I                          Eco RII Bsl I
                 Scr FI                            Bst NI  Eco RII                 Bsm FI
            Rsa I                                  Bss KI  Bss KI                  Bsr I
       Bsr I Nci I                                 Bsa JI  Bsa JI                  Bsl I
       Bsl I Eco HI                                                                Bfi I  Bsa JI
       Bfi I Bss KI         Msl I                  Cvi JI  Bsm FI
     Mnl I  Csp 6I          Cac 8I
     acctcccagtaccccggtggcaggcatttagtgatagcccccggtggtaggcatttagtaaagttttcccagtc 6560
     tggagggtcatggggccaccgtccgtaaaatcactatcgggtccccggggccaccatccgtaaaatcatttcaaagggtcag
     6482   6489         6499            6516   6523                      6554  6560
       6485  6492           6504           6518    6525                       6555
       6486  6492                            6519   6526                      6555
       6486   6489                           6519   6526                         6558
            6492                             6519   6527
            6492                             6519   6526
            6493                                6521
            6493                                6521
                                                6521  6527
                                                6522
                                                6522
                                                6522
                                                6522
                                                6522
                                                     6526
```

```
                                    Hae III
                                     Cvi JI                Cac 8I                              Sty I
                                      Hae I                 Cvi JI         Taq I              Bsa JI
              Mwo I        Bfa I                  Alu I    Scr FI         Sau 96I
               Cvi JI       Mwo I                  Tse I    Eco RII       Hae III
               Alu I         Cvi JI      Bsp MI    Fnu 4HI   Bst NI        Fmu I                 Bsm I
              Ace III        Alu I  Cac 8I  Bbv I   Bss KI                Cvi JI  Hph I  Mme I
         ttgcctttgagagctgggaaagctaggccagcaggtagcagcttgcctggtcgaatggccccttggtgagtgttggaatgc 7600
         aacggaaactctcgacccttcgatccggtcgtccatcgtcgaacggaccagcttaccgggaaccactcacaaccttacg
             7531     7541  7547   7558     7566       7577   7584   7591
             7532      7541         7551   7558     7566      7577        7595
                       7542                7558     7566      7577
             7533      7543                7560  7566         7577
                       7545                7560            7571    7580
                         7546                   7561                 7580
                         7546
                  Scr FI
                   Eco RII
                    Bst NI    Cvi JI
                     Bss KI    Alu I
                   Tse I       Ace III
                    Fnu 4HI   Dde I
                     Bbv I    Bse MII                                                 Cvi RI
              Bsm AI  Cvi JI   Blp I                                                   Bsg I
               Bsa I   Alu I    Cvi JI   Mme I   Bst 4CI       Tth 111II              Cac 8I
         tggaaacccagagaccaaagctgccaggctcagctccaacacagtctcatttgtttggtttgtggcagactgcctgcacc 7680
         acctttgggtctctggtttcgacggtccgagtcgaggttgtgtcagagtaaacaaaccaaacaccgtctgacggacgtgg
           7611    7619   7627    7635  7641     7652                          7672
            7611    7619   7628                    7644                          7674
                    7620    7629                                                 7675
                            7629
                    7620
                         7631
                    7620
                         7624    7632
                          7624   7632
                          7624
                          7624
                 Bsr I         Mnl I                             Bsm AI
                  Bfi I         Bse RI                            Bsa I      Bsr I
              Mnl I            Mnl I        Mnl I  Mse I         Bst 4CI     Bfi I       Mnl I
         ccaacccctttcctccccagtcttgcctcctcctgccccctctcttaaactcttacggtctcaaagactgggtttgaggga 7760
         ggttgggaaaggaggggtcagaacggaggaggacggggagagaatttgagaatgccagagtttctgacccaaactccct
             7691          7705         7718  7724       7734         7746    7755
                  7695    7706                            7736         7746
                  7696         7708                       7737
                                                   Mse I
                                     Tsp 509I      Ahd I           Tsp 509I      Tat I
               Bst 4CI               Mfe I     Bsm AI     Bfa I    Apo I    Mse I   Bst 4CI
                                                                                     Bsr GI
         aacctactgtaatggattgatatacttctccttcaattgacaagagacttaatgtcctagagaaaaatttttccttaaact 7840
         ttggatgacattacctaactatatgaagaggaagttaactgttctctgaattacaggatctcttttttaaaaggaattga
         7766                      7794    7804       7817    7825     7834 7840
                                    7795     7806                7826      7838
                                              7809                                7840
```

Fig. 3B-27

```
                                                                    Rsa I
                                                                    Csp 6I
                                                                    Nla IV
                                                                    Kpn I
                                                                    Ban I
                                                                    Acc 65I
                                          Dde I              Bfa I
                                          Bse MII            Sty I
  Rsa I      Tsp 509I                Mwo I                   Bsa JI
  Csp 6I     Apo I       Bst 4CI     Cvi RI                  Avr II
  gtacatatccaaatttcaaaaatgtataacagtcagtatcaatgcaaactgagcaatctgcctaggtacctataaacaca 7920
  catgtataggtttaaagttttacatattgtcagtcatagttacgtttgactcgttagacggatccatggatatttgtgt
   |          |            |         | |             | ||         ||
  7841       7851         7869      7883          7901
  7841       7852                   7884  7889    7901
                                         7889    7901
                                                 7902
                                                 7905
                                                 7905
                                                 7905
                                                 7906
                                                 7906
                                                      Bfa I
  caagatacctataaacacacaagatacctataaacacacaagatacctataaacacacctagatacctataagcacacaa 8000
  gttctatggatatttgtgtgttctatggatatttgtgtgttctatggatatttgtgtggatctatggatattcgtgtgtt
                                                            |
                                                          7979
    Mwo I
    Cvi JI
    Alu I    Bsp 1286I Tsp 509I
    Hin dIII Bsi HKAI    Bsr I        Mnl I            Tsp 509I        Apo I
    gaagcttatagagcaccaattagactggaacagaaaagaaaatcctcctgccacataataacccaatttcttttttcaaag 8080
    cttcgaatatctcgtggttaatctgaccttgtcttttcttttaggaggacggtgtattattgggttaaagaaaaagtttc
    |||       |        |       |           |                      |                |
    8002     8011      8024     8044                             8065              5080
    8003    8011
    8003    8018
    8004
                                                                           Mbo I
                                                                           Dpn I
                                                          Sts I            Cha I
                                                          Fok I            Bsp KT6I
                                              Bsp 1286I      Hpa II        Bst YI
      Mse I                                   Ban II         Hae III       Bgl II
      Dra I                               Cvi RI             Cvi JI    Sfa NI
    Tsp 509I  Ssp I      Rle AI    Bsg I  Cvi JI Mnl I  Bst f5I  Bsc AI      Bsl I
    aattttttaaaaatatttttattttatgtgtgtgtgggtgtgtgcagagcccatagaggccggatgagagcatcagatctcc 8160
    ttaaaaaattttttataaaaataaaatacacacacaccccacacacgtctcgggtatctccggcctactctcgtagtctagagg
    |    ||     |                |     |    ||    ||      |    |       |    |         |
    8081       8092             8111   8120 8126  8134  8140        8148              8160
         8086                         8121         8136         8148
         8087                        8125          8136       8153
                                    8125           8138       8153
                                                   8140       8154
                                                   8140       8154
                                                              8154
                                                              8154
```

```
                                                                          Apo I
                                                                          Cje PI
                                          Dde I                   Nla III
                              Cvi JI  Tsp 509I      Tsp 509I      Cvi AII
  Cje I   Cje PI    Cvi JI  Cje PI Cje PI  Bse MII  Apo I    Cvi JI  Bsp HI  Tsp 509I
actgaaacaaatgatggaaaatggcttctccccagaagccatcaattctcagtagaaattcaagaagcccattcatgaaa 8880
tgactttgtttactacctttaccgaagagggtcttcggtagttaagagtcatctttaagttcttcgggtaagtacttt
8807  8813    8823   8832  8839  8848    8856     8866  8873  8880
                            8837 8844                              8874
                                 8848               8857           8874
                                                                     8877
                                                                      8879
```

```
                Cvi_RI
                Bsg I
       Hae III  Tse I
       Cvi JI   Fnu 4HI                                    Nla III
       Hae I    Bbv I                                      Cvi AII
Nla III         Cvi JI  Cvi JI              Bst 217I  Cvi JI
Cvi AII         Alu I   Alu I  Hph I        Acc I     Alu I        Dde I
attcatgaaggccacaggaagctgcacccaagctaatcacctacctttgccaagtatactgaaatagctccatgttctt 8960
taagtacttccggtgtccttcgacgtgggttcgattagtggatggaaacggttcatatgactttatcgaggtacaagaa
8884      8901        8912 8918           8935        8947     8958
8884      8901        8912                8935        8947
  8890    8902                                                8952
  8891    8902                                                8952
  8891    8902
          8903
          8904
```

```
                              Msl I
                              Tse I
                              Fnu 4HI                 Tai I
       Bst 4CI                Bbv I                   Mae II
       Acc I    Tth 111II     Cvi RI                  Bsm BI
                              Tsp 509I                Bsm AI
agtatgtctactgttccgtgtgcttggcacaggtctgtaattgcagcacttgggtgtatgtggtagagagagacgtttca 9040
tcatacagatgacaaggcacacgaaccgtgtccagacattaacgtcgtgaacccacatacaccatctctctctgcaaagt
8966         8981         8999                              9030
  8970                         9002                         9030
                               9003                              9033
                               9003                              9033
                               9003
                                 9007     Nla III
                                          Cvi AII
                                          Ppu 10I
                                   Scr FI Nsi I
                                   Eco RII Sfa NI
                                   Bst NI  Bsc AI
                                   Bss KI  Sts I
                                   Hae III Fok I     Bsm AI      Cvi_RI
                                   Cvi JI  Bst F5I  Bsa I        Bsg I
                                   Hae I   Bfa I  Cvi RI  Tsp 509I       Tsp 509I
        Mnl I                      Mnl I  Cvi JI  Bfr BI  Sim I  Mse I  Bsl I
ggtgttcagggttatcctctttggcgatatagtgagtttgaggccaggctaggatgcatgagacccttaattcctgcac 9120
ccacaagtcccaataggagaaaccgctatatcactcaaactccggtccgatcctacgtactctgggaaattaaggacgtg
           9056             9080  9087  9094     9102  9108 9114
                            9081  9089  9095                    9110
                            9082        9092    9100            9115
                            9082        9092    9100            9116
                              9084      9093
                              9084      9093
                              9084      9094
                              9084      9094
                                        9094
                                           9097
                  Fig. 3B-31              9097
```

```
                                                                        Mbo II
Mse I                                    Tsp 509I                       Ear I
|                                        |                              |
ttaaatgttttattgtatgcttttcctattttgttttttggagtaattttggcaggaaaaaaagtaataaaatgaagag 10320
aatttacaaaataacatacgaaaaggataaaacaaaaaacctcattaaaaaccgtccttttttcattattttacttctc
|                                       |                              |
10241                                   10285                          10315
                                                                       10315
                                           Rsa I
                                           Csp 6I                  Dde I
                                           Tat I                   Bse MII
                                           | |                     |  |
tttgaagttgaaaaatataaaacagcaaccaaagggaaatactcactttagaaatgagtacattcaaatatacctgagaa 10400
aaacttcaacttttatattttgtcgttggtttcccctttatgagtgaaatctttactcatgtaagtttatatggactctt
                                           | |                     |  |
                                           10377                  10394
                                            10378                  10394
                                            10378
                                  Cvi RI
                                  Sfa NI                      Mnl I
         Mse I       Cvi JI  Hph I Bsc AI    Mse I        Sml I
         |           |       |    |          |            Bce 83I
                                                          |
atcattacattaaaactatataaagtaaagccaagtggtgatgatgcacacctttaatcccagcacttgagaggcaaagg 10480
tagtaatgtaattttgatatatttcattcggttcaccactactacgtgtggaaattagggtcgtgaactctccgttcc
|                   |       |    |          |            |
10410               10429   10437 10443     10454         10466
        Sfa NI                    10443                   10466
                    Sfa NI         10445                        10471
                    Bsc AI         Scr FI
                    Cvi RI         Eco RII
                    Ppu 10I  Tsp 209I   Bst NI
                    Nsi I    Eco RI     Cvi JI                  Scr FI
                    Bfr BI   Apo I     Cac 8I                   Eco RII
                    Sfa NI   Dde I     Hae III                  Bst NI
    Mnl I   Mnl I   Bsc AI   Bse MII   Hae I Bss KI   Cvi RI    Bss KI
    |       |       |        |         |    |         |        |
cagaagcagagaggcagagagaggcagatgcatctctgagaattcaaggccagcctggtctacaatgcaagttccaggac 10560
gtcttcgtctctccgtctctctccgtctacgtagagactcttaagttccggtcggaccagatgttacgttcaaggtcctg
|       |       |        |        |   |        |         |        |
10491   10501 10507     10516   10527 10534    10546      10554
               10507     10516   10528  10538              10554
                         10508   10520  10528              10554
                         10508   10520  10529              10554
                         10508   10521  10532
                         10509          10534
    Cvi JI               10510          10534
  Scr FI                 10510          10534
  Eco RII
  Bst NI
  Bss KI
  Bsa JI                                     Hin cII
  Cvi JI  Bsm I           Bsm AI      Drd I  Bsr I
  |       |               |           |      |
agccagggctgttgcattcggaaaccctgtctcaaaacaaaaacaaaacaaaacgactaaccagtcaacaatagataacaa 10640
tcggtcccgacaacgtaagcctttgggacagagttttgttttgttttgttttgctgattggtcagttgttatctattgtt
|       |               |           |      |
10561   10573           10589              10614 10620
         10563 10574                               10623
         10563
         10563
         10563
         10567
                                                              Rle AI
                                                              Nla III
                                                              Nsp I
    Nla III                                                   Cvi RI
    Cvi AII         Mse I Mse I                      Tsp RI   Cvi AII
    |               |    |                           |        |
catcatgccctgtataaaatacctacaagttaatgttaaaacacaagtcaatagagtagggaaaggcagtgtgcatgtg 10720
gtagtacgggacatattttatggatgttcaattacaatttgtgttcagttatctcatcccctttccgtcacacgtacac
|                   |    |                           |        |
10644               10670 10676                      10708  10715
10644                                                      10713
                                                            10714
                                                            10715
                                                            10717
```

Fig. 3B-35

```
                Rsa I
                Csp 6I                                                                 Dde I    Cvi JI
                Tat I                         Tfi I              Mnl I      Tfi I      Alu I
                Sca I  Nde I     Cje I       Tsp 509I Hin fI    Tth 111II   Hin fI     Hin dIII
                Sca I  Nde I Mme I          Apo I  Bsl I      Tth 111II   Mnl I        Bse MII
gggagtactcatatgtccaacaaaagtaaaaatttgccagaatcaggtgtttgtttgagggaggggaatctcaggaagct  10800
ccctcatgagtatacaggttgttttcattttttaaacggtcttagtccacaaacaaactccctccccttagagtccttcga
         10724 10730 10736           10750  10757      10768       10781    10790
         10724       10737           10751       10760        10772    10786    10796
           10725                                  10760            10777 10786    10797
           10725                                                               10790 10797
                                                      Mwo I
                                                      Bfa I
                                                      Nhe I
                                                      Cac 8I
  Eco RV              Nla III                         Ace II
                      Cvi AII    Mnl I    Msl I                 Cvi JI
tgggatatcttgttcaactcatgctcctgcctccaccattcaagtgctagcagtatadgccttctttttttatttatttat 10880
accctatagaacaagttgagtacgaggacggaggtggtaagttcacgatcgtcatattcggaagaaaaaataaataaata
      10804           10820          10830 10837   10846       10858
                        10820                        10846
                                                     10846
                                                     10846
                                                       10837
                                                        10850
                                                                Sth 132I              Mnl I
ttatttatttatttatttattttttattagatattttctttatatacatttcaaatgctatcccgaaagttccctataccc 10960
aataaataaataaataaataaaaataatctataaaagaaatatatgtaaagtttacgataggcttcaagggatatggg
                                                                    10941           10959
                                                   Scr FI
                                                   Eco RII
                                                   Bst NI
                                                   Bss KI
                                                   Bsa JI
                                                   Sau 96I                   Bsr I
                                                   Hae III        Mnl I
       Aci I                                       Fmu I          Bsl I
       Mnl I    Mnl I                              Cvi JI  Bsm I  Bsl I  Bfi I
tccctccgccctccaccccctacccacccactcctgcttcttggccctggcattccctctactggggcatataaagttta 11040
agggaggcgggaggtggggatgggtgggtgaggacgaagaaccgggaccgtaaggggagatgacccgtatatttcaaat
10963 10970                                          11002 11009 11015 11021
    10966                                            11002         11016
                                                     11002         11016
                                                     11002                11021
                                                         11004
                                                         11005
                                                         11005
                                                         11005
                                                         11005
                           Sau 96I
                Nla III    Nla IV
                Cvi AII
                Nsp I      Hae III
                Bsp LU11I
                Afl III   Fmu I   Tfi I              Cvi JI                Pfl MI
Cvi JI          Tth 111II Cvi JI  Hin fI             Alu I                 Bsl I
gtataagccttcaataacaaacatgttcggccccagaatccccatattcaaagctctgtaatgtagcaaaaagtccacaa 11120
catattcggaagttattgtttgtacaagccggggtcttaggggtataagtttcgagacattacatcgttttcaggtgtt
   10708        11058     11069 11076            11092                     11115
                    11061 11069 11076            11092                     11115
                    11061      11069
                    11061
                    11062
                       11062
                                 11069
                                 11069
```

```
                        Sml I
     Msl I   Bsp 1286I  Bce 83I                                                             Mse I
     caaagtcatctatgtgcccattactcaagtcatattcaggagaaaggggggggtggaaaaggttgaagtccttaatctgat 12160
     gtttcagtagatacacgggtaatgagttcagtataagtcctcttcccccccacctttttccaacttcaggaattagacta
         12087 12094    12104                                                        12151
                        12104
                                                                                        Scr FI
                                                                                        Nci I
                                                                                        Hpa II
                                                                                        Eco RII
                                                                                Mwo I   Bss KI
                                                                                Cac 8I  Sth 132I
              Cvi JI                                                            Tth 111II   Tsp RI
              Alu I                                                             Cac 8I  Bsl I
     Mae III  Bfa I                         Hph I
     tgtaaccagcttctaggttcacaaaggcagtaaggtgaaggacaggacaacattgaaaactgcctgcttgccgggcagtg 12240
     acattggtcgaagatccaagtgtttccgtcattccacttcctgtcctgttgtaacttttgacggacgaacggcccgtcac
         12162     12173                12194                              12222  12231
                   12168                                                       12225     12236
                   12168                                                       12226
                                                                            12226 12232
                                                                                    12231
                                                                                    12231
                                                                                    12231
                                                                                    12231
                                                                                    12231
                                                                                    Scr FI
                                                                            Cac 8I  Eco RII
                                                                            Hae III
                                                                            Cvi JI   Acc I
                                                                            Hae I   Bst NI
                           Pfl MI                          Dde I    Taq I   Bss KI
              Mse I        Bsl I      Mnl I     Bsm AI     Bse MII  Mnl I   Cvi JI   Sfc I
     gtggactttaatcccagcacttgggaggcagagacaagtggatttctgagttcgaggccagcctggtctacagagtgagt 12320
     caccctgaaattagggtcgtgaaccctccgtctctgttcacctaaagactcaagctccggtcggaccagatgtctcactca
         12248 12254         12265 12271            12286  12294 12300  12308
               12254                                  12286 12292     12302
                                                         12295  12302
                                                         12296         12306
                                                         12296
                                                         12297
                                                                       12302
                                                                       12302
            Bst 4CI
     Scr FI
     Eco RII
     Bst NI
     Bss KI     Cvi JI        Bsm AI                                                 Tth 111II
     tccaggacagtcagggctatacagagaagtctcatctcaaaaaaaaaaaacaaaacaaaaaaaaacaaaacaaaaacaaa 12400
     aggtcctgtcagtcccgatatgtctcttcagagtagagttttttttttttgttttgttttttttgttttgttttttgttt
     12322      12335         12349                                                    12397
     12322
     12322
     12322
            12327
                                                                              Cvi JI
                Tth 111II                                                     Cje PI
                Tth 111II                                                     Bsp 1286I
     Tth 111II  Tth 111II              Mse I                                  Ban II   Bpm I
     caaacaaacaaacaaacagaaaactgccttctgggtattaaaagtgtgtttcaacgaacatagagcccatctggagagat 12480
     gtttgtttgtttgtttgtcttttgacggaagaccatatttttcacacaaagttgcttgtatctcgggtagacctctcta
     12401       12413                           12438                     12463   12471
           12405                                                                 12463
                12409                                                            12463
                                                                                 12464
```

```
                                              Hae III
                                              Cvi JI
                                              Msc I
                                              Hae I
                                              Eae I
                                              Nla III
                                              Sty I
                                              Nco I
                                              Bst DSI
        Tsp 509I          Bfa I               Bsa JI                      Aci I      Tsp 509I
  Mse I  Apo I      Xba I          Sim I  Cvi AII                  Bsm I        Psi I Apo I
tttaaggaaattctgtcaagtctagaaaacagaccccatggccacacacaacaaagaatgcggatttttataaaaattta 12800
aaattccttttaagacagttcagatcttttgtctggggtaccggtgtgtgttgtttcttacgcctaaaatattttaaat
12722 12728        12741      12752 12758                    12777    12788 12794
     12729              12742        12757                        12781       12795
                                     12757
                                     12757
                                     12757
                                     12758
                                     12760
                                     12760
                                     12761                                      Cje I
           Tsp 509I                  12761                                      Rle AI
           Apo I         Tth 111II                                              Cvi JI
     Mnl I              Cvi RI              Bsr DI                    Bsm FI   Bsl I
     cacctcaaattccaatatgcaaacacacttcaagtaaatgagcaatgggcgtgtgagaaatctttggtatgggacaagcc 12880
     gtggagttttaaggttatacgtttgtgtgaagttcattactcgttacccgcacactctttagaaaccataccctgttcgg
     12803            12818            12842                       12871   12879
          12807           12820                                              12877
             12808                                                           12879
                                                                             12880
                              Dde I
                              Bse MII  Cvi JI        Tse I
                              Bsa I    Dde I         Fnu 4HI
  Dra III       Cvi RI   Sfc I  Bsm AI Bse MII       Bbv I    Cvi JI       Bfa I
  cacacagggtgtccttgcaaggacattctataggtctcagaactgagccttcgttatgctgctggaagccatctttatct 12960
  gtgtgtcccacaggaacgttcctgtaagatatccagagtcttgactcggaagcaatacgacgaccttcggtagaaataga
  12883        12896       12908 12914    12923      12938      12947       12959
                                 12913    12923      12938
                                 12916    12926      12938
                                 12916
                                     Hph I
                                     Scr FI
                                     Eco RII
                                     Bst NI                        Eco 57I
  Cvi JI           Tth 111II          Sex AI         Mae III       Mwo I
  Alu I      Cje PI       Cje PI     Bss KI    Tsp 509I     Alw NI Cvi JI     Sfc I
  agctccgttgagtgagagtttgcttgggaacagacctggtgataattatgtaacaggcagaaactggctgaaggtgctgt 13040
  tcgaggcaactcactctcaaacgaaccccttgtctggaccactattaatacattgtccgtctttgaccgacttccacgaca
  12961      12976     12988  12995      13004       13018 13026       13037
  12961          12981        12994         13010          13023
                                 12995                         13027
                                 12995                         13028
                                 12998
        Tsp 45I              Mnl I
        Mae III              Mnl I         Sim I        Dde I
                             Bse RI        Tsp RI       Bse MII
     agcaagtgacacaaataaacttgttcattcttggaggagggagcagtgggtcaaaactctgagaaagaaaggacaatc 13120
     tcgttcactgtgtttatttgaacaagtaagaacctcctccctcgtcacccagttttgagactcttcttcctgttag
           13046              13074         13085         13101
           13046              13074                       13101
                                 13077     13090
```

```
                                                                    Sau 96I
                                                                    Hae III
                                                                    Fmu I
                                                                    Cvi JI
                                                                    Sau 96I
                                                                    Pss I
                                                                    Nla IV
                                                                    Fmu I
                                                                    Eco O109I
                                                                    Bsp 1286I
                                                                    Bsp 120I
                                                                    Bah II
                                                                    Apa I
                                                                    Pss I
                                                                    Nla IV
                                                              Scr FI
                                                              Eco RII
                      Cvi RI                                  Cje PI
                      Sfa NI                                  Bst NI
         Dde I        Bsc AI                                  Bss KI        Hph I  Cvi JI
         Bse MII      Sts I                                   Bsa JI
         Mnl I        Fok I                                   Bci VI  Eco O109I     Alu I
         Hae III      Bst F5I                                 Mnl I   Bci JI  Mnl I Ace III
         Cvi JI       Mnl I       Mnl I
         ggcctcagtaggagaggatgcacatatcctcacagaaacttgatgtgtcaggg tgggaggatacccaggggccctcacca 13440
         ccggagtcatcctctcctacgtgtataggagtgtctttgaactacacagtcccacccctcctatgggtccccgggagtggt
         13361         13374       13388                      13417  13424    13423 13439
         13361         13376                                  13419         13428       13440
         13363         13376                                         13425       13435
         13364         13376                                         13425              13440
         13364         13377                                         13425
                      13377                                         13425
                      13379                                         13425
                                                                    13425
                                                                    13428
                                                                    13428
                                                                    13429
                                                                    13429
                                                                    13429
                                                                    13429
                                                                    13429
                                                                    13429
                                                                    13429
                                                                    13429
                                                                    13430
                                                                    13430
                                                                    13430
                                                                    13430
```

Fig. 3B-44

```
                                          Bpm I
                                          Scr FI
                                          Eco RII
                                          Bst NI
                                          Bss KI
                                          Bsl I
                                          Vpa K11AI
                    Nla III               Sau 96I
                    Mbo I                 Fmu I
                    Dpn I                 Ava II
                    Cha I                 Pss I
                    Alw I                 Ppu MI
                         Mnl I   Nla IV                       Sts I
                    Cje PI Cvi AII  Eco O109I                 Fok I
Dde I  Mbo II                                                 Bst F5I
Bse MII      Mnl I   Mbo II Bsp KT6I Bsm FI        Tsp RI
gctcagagaagaatggg agggagaaggaagaaggatcatgggaggggggacctggagttgggggcagtgagcaggatgt 13520
cgagtctcttcttaccctccctcttccttcttcctagtaccctcccccctggacctcaaccccgtcactcgtcctaca
     |    .        |           | |       | |    |   .        |        |
  13442        13457        13467 13474     13488          13506    13515
13442 13448             13470  13477    13488                        13515
                          13473  13482 13488                         13515
                                   13474  13488
                                   13474  13488
                                   13474  13489
                                    13477 13489
                                          13489
                                          13489
                                          13492
                                          13492
                                          13492
                                    Scr FI 13492
                                    Cvi JI 13492
                             Scr FI         13493
                             Eco RII Eco RII
                             Bst NI  Cje PI
                             Bss KI  Bst NI       Cac 8I
                             Bsm AI  Nla IV       Hin P1I         Pfl MI
                             Tsp 509I Bpm I Bss KI  Hha I  Mse I  Bsl I
aaagtgaataagcaaaaaaaaaaaaaaaaattgtctcctggagccaggcgtggtggcgcgcacgcctttaatcccagcact 13600
tttcacttattcgttttttttttttttttttaacagaggacctcggtccgcaccaccgcgtgcggaaattagggtcgtga
        .         |        |    |            |           |      .
                13550     13555 13565       13577       13587 13593
                      13554  13561                   13579        13593
                             13558  13565
                             13558  13565
                             13558  13565
                                 13563
                                    13565

Scr FI                  Cvi JI
                                        Eco RII                 Scr FI
                                Cac 8I                          Eco RII
                                Hae III                         Bst NI
                                Cvi JI          Acc I    Scr FI Bss KI
                                Hae I    Bst NI          Eco RII
          Cac 8I         Dde I  Taq I    Bss KI          Bst NI Bsa JI
Mnl I Mnl I              Bse MII Mnl I Cvi JI   Sfc I    Bss KI Cvi JI
tgggaggcagaggcaggcagatttctgagttcgaggccagcctggtctacagagtgagttccaggacagccagggctaaa 13680
accctccgtctccgtccgtctaaagactcaagctccggtcggaccagatgtctcactcaaggtcctgtcggtcccgattt
     |   |              |   |    |      |          |      |       .
 13604 13610         13625 13633 13639  13647      13661  13668
         13613         13625 13631          13641   13661  13670
                              13634  13641          13661  13670
                                13635                      13670
                                13635  13645               13670
                                13636                      13670
                                   13641                      13674
                                   13641

```
                                                                    Bfa I
   Cvi JI                                                           Cvi JI
   Scr FI                                                           Bsp 1286I    Nla III
   Eco RII                                            Tsp 45I       Ban II       Cvi AII
   Cje PI                                                           Bsp 1286I    Nla III
   Bst NI                                                           Ban II       Cvi AII
   Bss KI      Cac 8I       Msl I   Mae III  Mbo II   Nla IV        Nsp I
ataagataatccaggctatatccagcgagcaatacacttttgtgacttttcttcataggagccctagagcatgttttta 16000
tattctattaggtccgatataggtcgctcgttatgtgaaaacactgaaaagaagtatcctcgggatctcgtacaaaaat
       15931          15945   15955  15962  15970  15978        15989
       15931                         15962         15979        15990
       15931                                       15979        15990
       15931                                       15980
       15931                                            15984
   Mbo I 15934
   Dpn I
   Cha I
   Bsp KT6I                              Bsm I                        Mwo I  Bfa I
gtgaaaatgatctccataggattggaacagaaagagaaaaggaagcattctgaaacaccccccatagcagtctgctctcc 16080
cacttttactagaggtatccctaaccttgtctttctcttttccttcgtaagactttgtgggggtatcgtcagacgagagg
      16009                                16046                        16074 16080
      16009
      16009
      16009
                       Sch I
                       Ple I
                       Mly I                   Sch I
                       Hin fI                  Ple I
           Dde I                                Mly I                Cvi JI
           Bse MII     Tsp 45I                  Hin fI               Scr FI      Cvi JI
   Eco 57I             Mae III                Dde I                  Eco RII     Nla III
   Cvi JI  Mnl I      Tai I       Tsp 509I    Bse MII       Mse I    Bss KI      Cvi AII
   Alu I  Cvi JI      Mae II      Apo I  Mae III  Bsm FI             Bsa JI      Nsp I        Bpu 10I
tagcttcagcctcagacaaacgtgactcattagaaattcaagtaactgagtcccttaatccccaggctgacatgcaactc 16160
atcgaagtcggagtctgtttgcactgagtaatctttaagttcattgactcagggaattagggtccgactgtacgttgag
     16082 16088    16100         16114   16122  16130     16141    16150         16160
     16082  16090   16100         16115   16126           16135 16142 16151
           16091    16102                         16126         16142 16151
                    16102                                16128         16153
                    16104                                16128
                    16104                                16128
                    16104                                16128
                    16104
   Cvi JI
   Alu I
   Sac I
   Ecl 136II
   Bsp 1286I
   Bsi HKAI                Cvi JI   Sch I
   Ban II                  Alu I    Ple I                                               Cvi JI
   Dde I   Taq I           Dde I    Mly I               Mnl I                  Tsp 509I
   Bse MII  Bsr DI         Bpu 10I  Hin fI    Eco 57I                Cvi JI    Bfa I
ctgagctcgaacattgccccaccttagctttcataagactcaaaccgacctgaaggagggaaaaaaagcccaattcta 16240
gactcgagcttgtaacggggtggaatcgaaagtattctgagtttggctggacttccctccctttttttcgggttaagat
     16161      16172    16182     16197     16210               16229   16238
     16161 16167         16183     16197                16217     16234
     16163               16186     16197                                  16240
     16163               16186
     16163
     16163
     16163
     16163
     16164
     16164
```

Fig. 3B-52

```
                                    Rsa I
                                    Csp 6I
                                    Tat I            Tfi I
                  Cje PI             Bsr GI    Cje PI Hin fI
      Cje PI
      Mwo I           Mse I   Sth 132I  Bst 4CI  Sim I Mbo II              Bst 4CI
      gcccaccacgcttctgcttaaccgacgggaaggaaaactgtacaagacccaagaagaatcgctgtgatgaccacagttga  16320
      cgggtggtgcgaagacgaattggctgcccttccttttgacatgttctgggttcttcttagcgacactactggtgtcaact
      16241        16258  16258     16277  16286 16293                   16313
          16243                        16279      16289 16296
                                       16279           16296
                                       16280
                                       16280
```

Multiple
                                                    Xite promoter.
                                                    ε start sites
                                                    within this
                                      1.2kb         fragment:
                          Mnl I    Xite(enhancer of Tsix)  orientation ↵
                          Hae III    Stu I - Xho I
                          Cvi JI     fragment
           Cvi JI         Stu I                          Tai I
           Alu I          Hae I                          Mae III
                                                         Afl III
```
      gtggcatagatacagctaataacaccctgccaccatcaaggcctcctgtaatatcagagaaatacaataacgtgtcata  16400
      caccgtatctatgtcgattacttgtgggacggtggtagttccggaggacattatagtctctttatgttattgcacagtat
      16334              16360                                          16391
      16334              16360                                          16391
                         16361                                          16391
                         16361
                         16363
```

```
           Xmn I                Bfa I
      Dde I                     Xba I
      Bse MII  Tsp 509I  Bsm AI  Mwo I       Tsp 509I                       Mme I
      caactcagaactaattcaagaagtctctagagcaaccaaagcaacaaattaggaaaaataaagacacttggaacattctc  16480
      gttgagtcttgattaagttcttcagagatctcgttggtttcgttgtttaatccttttttatttctgtgaaccttgtaagag
      16404    16413   16423  16432         16447                           16479
      16404           16426
               16408  16427
```

```
      Mbo I
      Dpn I
      Cha I
      Bsp KT6I
      Alw I
      Nla IV
      Bst YI
      Bam HI
      Alw I
      Scr FI
      Eco RII              Tsp RI                                      Bst 4CI
      Bst NI       Cvi JI  Bst 4CI  Nla III     Mnl I                  Tsp RI
      Bss KI   Mnl I  Tth 111I  Cvi AII  Cvi JI                         Tth 111I
      Bsa JI
      caacctgggatccctctggctgtatcaaacagtggacacatggtatagccctcattttcaaccacatcaaacactgtatg  16560
      gttggaccctagggagaccgacatagtttgtcacctgtgtaccatatcgggagtaaaagttggtgtagtttgtgacatac
      16484  16493      16506   16519  16527               16548
      16484        16498   16509  16519     16530               16552
      16484                  16510                               16553
      16484
      16484
           16488
           16488
           16488
           16488
             16489
             16489
             16489
             16489
```

Fig. 3B-53

```
                        Bfa I
                        Cvi JI                Mbo I
       Cvi JI           Alu I                 Dpn I         Tsp 509I
       Alu I            Dde I                 Cha I    Bsl I
       Hin dIII         Bse MII               Bsp KT6I Apo I        Acc I         Cvi RI
       taaagcttactaaaacaaaaaaatctcagctagaaaatacagatcagaaccaaattcaggcgtggtagacatctgcaagg 16640
       atttcgaatgatttttgttttttttagagtcgatcttttatgtctagtcttggtttaagtccgcacctatctgtagacgttcc
            16563            16585           16602     16612        16625       16634
            16564            16585           16602     16610
            16564            16588           16602      16613
                             16588           16602                                Hpa II
                             16590                                                Bsl I
                                                                                  Sth 132I
                                                                                  Scr FI
                                                                                  Nci I
                                                                                  Eco HI
                                                                                  Bss KI
                                            Nla III                      Bsr I    Bsl I
                        Rsa I       Mse I                                Acc I    Bsa JI
                        Csp 6I  Tsp 509I    Cvi AII                      Bst 4CI  Sim I
       attagatggtacatctaattatgattaacatggtaaaagtgctaaaacaaaacaaaacggtagactggttttgaccccg 16720
       taatctaccatgtagattaatactaattgtaccattttcacgattttgttttgtttgccatctgaccaaaaactgggggc
            16649   16657    16669                             16697           16713
            16649            16665                                  16700          16716
                             16669                                      16704      16717
                                                                                   16717
                                                                                   16717
                                                                                   16717
                                                                                   16717
                                                                                   16717
                                                                                   16718
                                                                                   16718
                                       Scr FI
                                       Eco RII  Scr FI
                                       Bst NI   Eco RII
                                       Bss KI   Bst NI    Tse I
                                  Mwo I         Bss KI    Fnu 4HI
            Bsm FI        Msl I   Cvi RI  Cvi JI          Bbv I         Bsm FI
                                                     Bfa I              Alw NI
       gacaagggacagaagtgcttattttacatatcaatgcagacctggcttccaggttctactagcagcgttcagtccctgcc 16800
       ctgttccctgtcttcacgaataaaatgtatagttacgtctggaccgaaggtccaagatgatcgtcgcaagtcagggacgg
            16726              16747 16755   16764           16779        16790
                                     16756      16769        16782        16792
                                              16761 16769    16782
                                              16761 16769    16782
                                              16761 16769
                                              16761
                                              16761  Tse I
                                                     Fnu 4HI
                                                     Bbv I
                                                     Cvi JI
                                                     Alu I
                                                     Dde I
                            Bsr I       Blp I                    Tai I
                            Bsl I       Cvi JI         Cje I     Mae II
       tgatataccttgttcccaacccttgaactttccagttcagggcttagctgccttccacaagacgttctttccaatgtta 16880
       actatatggaacaagggttggaacttgaaaggtcaagtccccgaatcgacgggaaggtgttctgcaagaaaggttacaat
                                16831    16841           16856   16863
                                16831    16842                   16863
                                         16843
                                         16846
                                         16846
                                         16847
                                         16847
                                         16847

Fig. 3B-54
```

```
                                                                      Nla III
                                                                      Cvi AII
                                                                      Sty I
                                    Bss SI                            Nco I
   Bfa I    Hin PII    Mnl I Cvi RI Hin PII            Mnl I          Cje PI
   Xba I    Hha I      Bse RI Bsg I Hha I      Mbo II  Bse RI  Mnl I  Bst DSI
                                                                      Bsa JI
   tctagacattttgcgccccacccttctcctctctgcacgagcgcaccccttcttcccttttctcctctcccctctcccca 16960
   agatctgtaaaacgcggggtgggaagaggagagacgtgctcgcgtggggaagaagggaaaagaggagaggggagaggggt
   16881     16893     16906 16913 16921      16931   16942   16951  16958
   16882     16893          16908 16914 16921                 16944         16958
                                 16916                                      16958
                                                                            16958
                                                                            16958
                                                                            16958
                                                                            16959
                                                                            16959

Tsp RI   Sth 132I
             Mnl I    Bsr I    Nli 3B7/7I                       Cvi RI
             Bse RI   Cvi JI   Ava I            Cvi JI   Mse I
   tggcaactcctcaatccttgaagccagtgaactccccgagagcagttccccaataagcctacctttaatgcaatcggact 17040
   accgttgaggagttaggaacttcggtcacttgagggggctctcgtcaaggggttattcggatggaaattacgttagcctga
        16967        16982      16995                 17016   17025
        16969        16984      16995                                 17029
                          16985 16995

Nla III
                                                Cvi AII
                                                Cvi RI
                                                Ppu 10I
                                         Bsm AI Nsi I
                                  Mbo I         Bfr BI
                                  Dpn I         Nla III
                                  Cha I         Cvi AII      Bsm AI
   Bsm AI      Sth 132I           Bsp KT6I      Nsp I        Bsa I
   tgaatagtctcgtttcacgggcagagaagtcattgatcggagacaacatgcatgaataggagaccaacaccatcaacaca 17120
   acttatcagagcaaagtgcccgtctcttcagtaactagcctctgttgtacgtacttatcctctggttgtggtagttgtgt
        17047      17058              17075         17086        17100
                                      17075         17087        17100
                                      17075         17087
                                           17080    17088
                                                    17088
                                                    17088
                                                    17089
                                                         17091
                                                         17091

Bsp 1286I
   Sfa NI                                       Cvi JI           Bsi HKAI    Mbo II
   Bsc AI             Mse I      Bsm I          Alu I   Eco 57I              Bpm I
   accgatgctcaaaatcaatagcattaagaagtgagcattcataaagatttggaagctaacacttcagagcacactccaga 17200
   tggctacgagttttagttatcgtaattcttcactcgtaagtatttctaaaccttcgattgtgaagtctcgtgtgaggtct
        17124             17144     17155             17174 17182        17194
             17124                                    17174        17187       17199
                                                                   17187
                                                              Sfa NI
                                                              Bsc AI
                                                              Cvi RI
           Mnl I                          Tth 111II  Aci I          Cvi RI  Bsl I
   agaacaaatggggtgtgaggggaagggatttagttagggattttgcttgtcattggcggtgcatctctgcaatcccccaa 17280
   tcttgtttaccccacactcccctttccctaaatcaatccctaaaacgaacagtaaccgccacgtagagacgttagggggtt
                17217                     17244     17256    17268  17276
                                                     17260
                                                     17261
                                                     17261
```

```
                    Cac 8I
                    Hae III
                    Cvi JI
                    Msc I
                    Hae I
                    Eae I
                    Scr FI
                    Eco RII                          Tsp 45I              Nla III
          Dde I     Bst NI                           Mae III  Tsp 509I    Cvi AII
          Bse MII   Bss KI    Bst 4CI    Bsm AI      Tsp 509I Apo I       Bsp HI
          gaaactgagaaaatcctggccagcacagtcttgaatgtctctgtttccagaattgtgacctaaatttatctttactattc 19360
          ctttgactcttttaggaccggtcgtgtcagaacttacagagacaaaggtcttaacactggatttaaatagaaatgataag
          19285     19295     19305      19317       19331    19342      19359
          19285     19295                            19335    19343      19360
                    19295                            19335               19360
                    19295
                    19297
                    19297
                    19297
                    19298
                    19298
                    19299

Bfa I                            Dde I   Tsp 509I          Ssp I
          Mse I     Mnl I                        Bse MII          Bfa I   Mse I
          atgacttaatctaggttgaggaatgttgctataacaaaaaataatctgagataattgctctgactagaacatttaatatt 19440
          tactgaattagatccaactccttacaacgatattgttttttattagactctattaacgagactgatcttgtaaattataa
          19366     19378                        19406             19424   19433
                19371                             19406 19413                  19435

Mbo I
                          Dpn I
                          Cha I
          Mse I           Bsp KT6I
          gttaaaatactacttctgttcaaagtgatc 19470
          caattttatgatgaagacaagtttcactag
          19442           19467
                          19467
                          19467
                          19467
                          ↑
                    ┌─────────────────────────┐
                    │ Approximate             │
                    │ DISTAL END OF pSxn transgene │
                    └─────────────────────────┘
               pXite ◄─┘
               END
```

Fig. 3B-61

>wholeseq_42130 ?) extracted from 42130 to 43330, original sequence length: 121629
TCTCCCCAGGTCCCTGGCGCCGGCAGGCATTTTA
GTGATAGCCCAGGTCCCCGGTGGCAGGCATTTTA
GCGATAGCCCAGGTCCCCGGTGGCAGGCATTTTA
GCGATCTTCCAGATCCCCAGTGGCAGACATTTTA
GTGATAGCCCAGGTCCCCGGTGGCAGGCATTTTA
GTGATAGCCCAGGTCCCCGGTGGCAGGCATTTTA
GCGATAGCCCAGGTCCCCGGTGGCAGGCATTTTA
GCGATCTTCCAGATCCCCAGTGGCAGACATTTTA
GTGATAGCCCAGGTCCCCGGTGGCAGGCATTTTA
GTGATAGCCCAGGTCCCCGGTGGCAGGCATTTTA
GCGATCTTCCAGATCCCCAGTGGCAGACATTTTA
GTGATAGCCCAGATCCCCGGTGGCAGGCATTTTA
GTGACCTCCCAGATCCCTGGTGGCAGGCATTTTA
GTGATAGCCCAAGTCCCCGTGGCAGACATTTTA
GTGACCTCCCAGTAAGCGGTGGCAGGCATTTTA
GCGACCTCCCAGATCCCCGGTGGCAGGCATTTTA
GTGATAGCCCAGATCCTCGACGGCAGGCATTTTA
GTGACCTCCCAGATCCCCGGTGGCAGGCATTTTA
GTGACCTACCAGGTCCCCGGTGGCAGGCATTTTA
GTGATAGCCCAAGTCCCCGTGGCAGACATTTTA
GTGACCTCCCAGTAAGCGGTGGCAGGCATTTTA
GCGACCTCCCAGATCCCCGGTGGCAGGCATTTTA
GTGATAGCCCAGATCCTCGACGGCAGGCATTTTA
GTGACCTCCCAGATCCCCGGTGGCAGGCATTTTA
GTGACCTACCAGGTCCCCGGTGGCAGGCATTTTA
GTGACCTCCCAGGTCCCCGGTGGCAGGCATTTTA
GTGATAGCCCAGATACCCGGTGGCAGGCATTTTA
GTGATAGCCCAAGTACCCGTGGCAGACATTTTA
GTGACCTCCCAGTACCCGGTGGCAGGCATTTTA
GTGATAGCCCAGGTCCCCGGTGGTAGGCATTTTA    Unique insert in DXpas34
GTAAAGTTTCCCAGTCCCAGGCATCCATTTAAGCCATTAGTCCGGGAACGTGG-
CATGTATGTAAGCTATCTTTCCAGGTCCCTGACCG    Not a DXpas34 repeat
GTAGTCTAACCACCTGTAAGGGACAGACATTTTA     used repeat finder
AATTTTGGCTCCAGGACCCAGCAGACATTTT
AGTTATTCCTCCGTTATGCGGCAGGCATTTT

Fig. 4

TSIX RNA - UNSPLICED FORM, TOTAL SEQUENCE

FRAGMENT 1: TSIX 5' END

GTGCAGCGCT TGTGTCAGGC GCAATCTCGC AAGATCCGGT GAGGCGCTAC GTCGTGCTCC
ACTCGGTCCC AAAAGTACCT GCAAGCGCTA CACACTTGCG CTCGGCGCCC TTGCTCTGTT
CTCACTTTCC GAGATATCCA CGCATCTTGA GTCCTGCATC CACTCCCGGG AGGCGGCTGC
GGCAAGCGCG TGATGGAAGA AGAGCGTGAT AGCCAGCTAG ACAGGTGGCC AGAGCGGAGC
GGTGGGTGAG ATGCGGGCTA AGGAGAGGGC AGATGCCTAA AGTGCTGCGG GACGGTGGAG
AGGTGCCCGA AGTCCTTGTT GGGGTGGTGG AGAGGTGGCT GAAATTCTTG CGGGATAGTG
GGGCGATGGC TAAGTGCTTG CAGGACAGTG GGGCGATGGC TAAGTGCTTG CGGGACAGGG
GAGAGGTGGC TAAGTGCTTG CGGGACAGTG GGACAGTGGC AAAGTGCTTT CAGGACAGTG
GAGCGATGGC TACGTGCTTG CGGGACAGCG GAAGAGATGG TTAAAGTGAT TGCCAAGCAG
CAGAAAGATT CCTAAAATGC TTGCCAGCTA TGCGGAGATG AAGGTAAAAT GCCTGCGTAG
TCCCGAACCG ATAGTTAAAA TGCCTGCCGC ATAACGGAGG AATAACTAAA ATGTCTGCTG
GGTCCTGGAG CCAAAATTTA AAATGTCTGT CCCTTACAGG TGGTTAGACT ACCGGTCAGG
GACCTGGAAA GATAGCTTAC ATACATGCCA CGTTCCCGGA CTAATGGCTT AAATGGATGC
CTGGGACTGG GAAACTTTAC TAAAATGCCT ACCACCGGGG ACCTGGGCTA TCACTAAAAT
GCCTGCCACC GGGTACTGGG AGGTCACTAA AATGTCTGCC ACGGGGTACT GGGCTATCA
CTAAAATGCC TGCCACCGGG TATCTGGGCT ATCACTAAAA TGCCTGCCAC CGGGGACCTG
GGAGGTCACT AAAATGCCTG CCACCGGGGA CCTGGTAGGT CACTAAAATG CCTGCCACCG
GGGATCTGGG AGGTCACTAA AATGCCTGCC GTCGAGGATC TGGGCTATCA CTAAAATGCC
TGCCACCGGG GATCTGGGAG GTCGCTAAAA TGCCTGCCAC CGCTTACTGG GAGGTCACTA
AAATGTCTGC CACGGGGGAC TTGGGCTATC ACTAAAATGC CTGCCACCGG GGACCTGGTA
GGTCACTAAA ATGCCTGCCA CCGGGGATCT GGGAGGTCAC TAAAATGCCT GCCGTCGAGG
ATCTGGGCTA TCACTAAAAT GCCTGCCACC GGGGATCTGG GAGGTCGCTA AAATGCCTGC
CACCGCTTAC TGGGAGGTCA CTAAAATGTC TGCCACGGGG GACTTGGGCT ATCACTAAAA
TGCCTGCCAC CAGGGATCTG GGAGGTCACT AAAATGCCTG CCACCGGGGA TCTGGGCTAT
CACTAAAATG TCTGCCACTG GGATCTGGA AGATCGCTAA AATGCCTGCC ACCGGGGACC
TGGGCTATCA CTAAAATGCC TGCCACCGGG GACCTGGGCT ATCACTAAAA TGTCTGCCAC
TGGGGATCTG GAAGATCGCT AAAATGCCTG CCACCGGGGA CCTGGGCTAT CGCTAAAATG
CCTGCCACCG GGGACCTGGG CTATCACTAA AATGCCTGCC ACCGGGGACC TGGGCTATCA
CTAAAATGTC TGCCACTGGG GATCTGGAAG ATCGCTAAAA TGCCTGCCAC CGGGGACCTG
GGCTATCGCT AAAATGCCTG CCACCGGGGA CCTGGGCTAT CACTAAAATG CCTGCCGCCG
CCAGGGACCT GGGGAGATCG CTAAAATCCC TGCCTTATAA CCAACCCCTA GAGGTCGACT
AAAATGTCTG CTGGGCAGAG CAGAGGTGAT GAAAATGTCT GGGATAGCGT AGAGATGGTT
GGCTAAAATG TTACAGGTAG ATATGCAAAG CGTTCAATAA GCCTGGCGTG GGTAATAAAC
TGCAGTCTAG AGCGGAAAAG AAAGTTAAGG GCGTGACTTG TAGCAGGGTC TAGAATCCAC
ACACTCACAT CAGGGAAAGC CTCGTGTCCG AAAAACTCTT TGGAATAGTC TTAATATTTT
AATATTGCTC AAGCCAAATT CAGCAATACT ACCTCACCGC ACGTGTCTTT TTCAGGTAAG
ATTTTGCTC TTTTTTTTTT TTTTTGGTA ACAATTTTCC CGCCATGTGA TTATGCTAAA
AACCAATGGG ATTCTACCTC CGCTTTAGTG GGGTTTTCTG ATTGTACGCG TTTGGATTAA
AGTTGATGAA AGAATGTGGG GGGGGGCAC AGATTCAGAA AAGTGGAAAA ATTACTGGTA
GCGTGTGAAG TAACCAAGAA CGAGTAACTA AGTCTGCGAT AACTTTCTTT GAGAAGCCTT
GGAAGTTGAG ACCTAAAATT TTGGTACTGC GTTCCGTTTA TTTCCGAGGT ACATAATGAC

Fig. 5-1

```
CCGATCTCTG GTATCGTTGA AATTCGAAAA TAATCTGAGT GCTTTGAAAA CCCATTAAGT
TTCTACTATC TGGGACAAGG AGTATTTTCG GGGTGGGGGT GGCGGGCAAG GCAAAACAAT
TCTCAGTGGT TCGTATCTGA AAAATCATAT TCTTATTTAC TATAGGCACG GAAAATCCCT
CCCGGTAGTG TTTATTCAGT GTGTTCAGAC GAGCAAACAA TGGCACTAAG GAATGAATCC
AGTTTAGAAA GGAGGGAAAT TAACAATCAG CTTTGGTTTT GATGCGGATT TGGGGTGAAT
TTTGTTTTTG TTTTTTTTTT AATGCCTTAT TTCTGAGACA AGGTCTCAGT AAATAACCTC
AAACTCGCAA AGCTCTGCCT GCCACTGCCT TCAGTGGGAC AGTGCCGATT TTAAAGGCTT
CTGCCGCCAT GTTTGGATTA ATGTTCAGTT TTCAATTCGG AAGAGAAGAA AGATTTGCAA
AGTACTGATT TTGTAATACC TATGCAAATT CTTACCTGTG TTAGTAGGCA GACAAACACT
GACTCCCCAG AATATACTAA TATACTATAT TACATTGGAG GAAGAAACTG AGGTTTCTAA
TCAATCGACC TTGAGATAAA AAGATTCCCC TAGAAGGTAA GGTGTTGTTT CATTGAAATG
GCAGGGATAA AAGATTGACA AAGACTCTAC ATCGGCTATA GACATAGAGG AAGGCAATTA
CTAGCTAAGA AATTTGAAGC TAAAAGGGC AGGGAAATGA ATTCTCTAGA CTTACAGAAG
GAATAATTTC AATTTAATTT CAAATAATAA TTTCAATTTC AACTAGGTGT CTCACACTGA
ACTTCTGACT TCTAAAATTA TAAGGTTATA GATCTGTGTT GCTTTAAGCC ACCAAGTTTG
TTGGGGGCTT AAACAAATAC AGCACTGTAG TGCTACCTGT GTCTCTGTAT CTTCGTAGAG
GTTAAGGTGG TTATGAAGAC ATCCAGAAAA GGAATCATGA GATAGGCTAA GGCACAGAGT
ATGTCTTTTA TTTACAGTTT CTTTGTAGAA CACCTTTACC TAATGTCTTA ATCAGCTAAT
TAGCATAGTA AAATACAACT TTGGGTAGTT AGAGAACAAA TAGTGTGTCA TAGCTCAAGA
GGCTAGACCT CTCTAAAATG GAGGTTGGGT CTGGTGTTAT CCCTTCCTGT CTTCCTGGAT
TGTGAATGGC TGCCTTCTGG CTGCCCTGCG TCTGGTAAAG AGACAGACAG GTTTAGGCTC
CATTCTTAAG ACCTCATTTG ATTTGAAATT ACGTCTTTTA TTTAAAGGTT TTATGTACAT
ATGCAGTCAA ATTCGAATGG TTTCTTTCTT GCGCTTGTGT GTGTGTGTGT GTGTGTGTGT
GTGTGTGTGT GTGTTCATTT TTGAGACAGC ATTTCTCTAT GTAACAGCCC TGGTGTCTTG
GAACTAGCTC TGTAGACCAG GCTGGCCTCA AACTCACAGA GATCCTCCTG CTTCTCCCTT
CTTTTCTTGT GCTGTTGAAT AGAAATAGCC TCAGATCTGG TGAATAATGA GTTGATTACT
CAAAAACAAA GTTGGAAGCT TGTTTACATG TGCTGATATT GGCATGCCTG AGCAGCCAGA
CAGCTTTTTC TGTGCAATGT AAGTAGGGTC TTCTACTGAA ATCCATTTGG AATTATATAT
ACTCTATAGG TCTACTTTAT TATTATTTTA GATTTTACGT GTATGAGTGT CTGCTTGTT
TGCATGTTTG TGAATCATGT GTATGCCTGT TGGGCACCAA TGTCAGAAGA GGGTTTGCTA
GGATCCCTGG AACTGGAGTT ATAGATGGTT ATGAGCCACA ATGTGGGTGT TGGAAATCAA
ACCAGGTCCT CTGTGAGAAC AGAAAGTGCT CACATTAAAA AATAGTAGTT ATAGCTGGGC
AGGTGGCTCA CACTTGTTAG CACTTTAAAG GCAGAGGCAG AAAGGGATTG CAGCTAGTTC
AAGACTAGCT TGGGCTACAC AGTCAGTTCC TGACCAACTT GGCTAGAAAA CACATGTTTT
TGTTTTGTTT TGTTTTGTTT TGTTTTTAAG TAAACATCTG AGCTTACTAT TTAAACACAC
ACACACATGA GGGCATAGCC GCATTCAATT CATAGCAAAT AATAAAACTT TTATCAATAA
AAACTTATCA GGTCCTTGTA TAATGAAAAT GAAAGTTGAC GAATAAACAT GAAAGCCCAA
GAAATTAGAA TAAGGCTGGA AGTGAAAGTC CAAGGTAAAT GGAATTATAG GGGAAAGTGA
TGGTTTGAAT GTTGATGGTA ATTGAGGAGA CTACACATAG AAAACATTTA AGGCAGGCAT
TGGCATAAGT GAGGATTTGA TTGGGAAGAC TAACTCACTT TAGACAAATG GGTGGATGGT
GTCTTTATCA GAGTGCTATG TTCAAACATA CCCTTAAATT GACTTTTCAT CCTCAAGATT
```

Fig. 5-2

```
TCTTATGCCA GGAATTCCTT TTAGTGTTGG ATTTTACTAC CAGTGGTAAA AATATGAAAG
TGGGTTTTGT TTTTGTTTTG TTTCGTTTTG TTTCACACAC ACACACATAC ACACACACAC
ACACACACAC ACACACACAC ACACAATTGT TTTTTTGTTT TGTTTTGTTT TTTTGGTTTT
TCAAGACAGG GTTTCTCTGT GTAGTCCTGG CTGTCCTGGA ACTCACTCTG TAGATCAGGC
TGGACTTGAA CTCAGAAATC CGCCTGCCTC TGCCTCCTGA GTGCTGGGAT TAAAGGCATG
CGCATGCGGC ACCACACCCT GCTCACAATT GTTTTTAAAT ATGTGTGTCT GAGGCATTGG
CCCCCTGGAG ATGGAGTGAC AGAGGCTTGT GAGCTACCTG ACTTAGGTGC TTGCTAGCAA
ACTCAGGTCC TCTCAGCAAG AGCAACATGT GCTGCTAACT GCTGAGCTCT TCTTCCACCT
TTGTTCTTTT GAGACGCAGT CTCATGCAGT ACAGCTGGCT TTGAGTTTGC TCCGTAGCCA
ACGCTGACCT TGCCCTTCCT GCCTCCACCT TCCAAGTGTT GGGTTTTCCC TATATTTAAT
ATTTATTTAT TCCTTGGCAA TTTCATACAT GCATTCACTC GTACTTCTCC CCCACTCCCT
ACACATCCCG AAGCTGTCTT CCTATAACCT TAATGAGGTC TCCTTTTAAA ATAATAATAA
TAATATAATA ATAATAACAA CCCTGTGAGT CCAGTTAGCA GTGCTTGCTG GAATGTTGGC
TAATCTTGTC GGAATCGTAT GCAGGTAGCC ACAGCCGCAG TACGCTTGTG AGGGCGGCAG
CCAGCATTTT CACAGCTTGC CTCCCCATCT TTAGCTCTCA TGTTCTTTCC AGCCCTGCTT
CCACGATGTT CCATGGGCCT TGGGCAGTGT GTGGGTGCT ATAGACACCT TGTTTGGAGC
TAAGCATGCA ATTGTTGCTC AGTCTCAGGC CAGCTCTGAG TCTGCATTAG CTGCTCCTCC
TTGCAGAAGA AACTTCTCTG GCCAAGGTCG AGGAGAGTAC AGTATTGATT TGTTCTTGAG
ATAGAGTTTT CCAGGGTAGC CCTGGCTGGC TCACTATATA GTATAGCCCA GGCTGGTCTC
AAACTCACAG TGATCGACCT GCCTCTGCTT GCCAAGTGCT GGGATTAAAA GCACGTCCCT
CTCTGCCTGG CTCGACTTAT TTTTTGACAT GGGGACTCAC TGCCTGGTGT CCCCCTCCTC
CTATAGCCTC AAAATGGCTG AGCAAGAGTC AGGTAACTTG CTTCTCTGCC ATTCCTGAAG
CCCTGTGTTC CATCCGGAAC CTGCATAAAC CAGGTGAGGG GTGTGCTTGT AGTCACAGCA
CTGAGGTCAA GGCAGAAGTG TCAGAAATTC AAGGTCATCC TATCTACAAA GAGAATTTGA
GACCAGCCTG GGCTACAAGA CCCTGTCTCA AAACGTACAA ACAAGCAAAC AAACAAAAAA
CAAATTCAGG AGCTGAGAGA CGGCTCAGTA GTTAAGAGCA CTGACTGTAC TTCTAAAGGT
CCTGAGTTCA ATTCCCAGCA ACCACATGGT GGCTACAAC CGTCTGTAAT GGGATCTGGT
GCCCTCTTCT GGTATATCTG AAGACAGCAA CAGTGTACTA ATATAAATAA AATAAATAAA
CCTTTAAAAA AACAAAAAAC AAATTCAGGG GCTCCAGAAG AGTAGCAAAT GTTCTTGGTA
ACCACTGAGC CATCTTTCCA GCTCTCCTGT CCTTCTTTCT TTCCTTCCTT CCTTTCTTTT
TCTTCTCCTC TCCCCTCCTC TCCTCTCCCC TCCCCTCCTC CCCTCCCCCC TCCTCCTCCT
CCTCCTCCTC TTCTTCTTCC TCTCTCTCTC TCTCTCTCTC TCTCTCTCTC TCTCTCTCCT
CTTTCTTTCT TTTTTTTTTT GAGACAGAGT CTCATGACAT TGCCCAGGAT AGACCCAATT
CTTCATCTTC TTGCTCTAAA TCTCCCAAGT GCCGCGGTTA CAGGCCCTTG CCTCCAACAC
CAGCTGGTTC CTAGGTTCTA GATAGCTATT CCAAGTAGGT AGATGCGAGG GATATCCAAT
TATAGTTTGC TTCATTTCCC TAGTGGGAAT AGAGAATAAG GCCTTGTTTA TTTACTTACT
TTTAAAGGCT CTCATGTAGC CCAGCCCAGC CTTGAATTCT GATCCATGGT CCACCACCTC
CAGGCTTGCA ATGCCTACTG GCTTTTTTCA GACCTGTAGT CTTTTGTTGT TCGGTGTGTA
TGTATGTATT TATTTAGTGC ATTGGTGTTT TGCCTGAATG TAAGTCTGTA TGAGGGTGTC
AGATACCCTG GAACTGGACT TACAGACAGT TGTGAGCTGC CATGTGGGTG CTGGGAATTG
AACCACAACC ACGGTCCGGT CCGGAAGAGC AGCCAGCATT CTTAACCAAT GAGCCATTTC
```

Fig. 5-3

```
TCCAGCCCCT TTGTTTGTTT GTTTTTTAGG GACCAGTAAA TTAATTTTAA ACCTAGAAAG
CCCTCCCTTG TCTACAGAAT TCTTTTAGTT ATTCTTTCTA TTGGAACTGA GCTTAGGGTG
AGTGCTTGGT TAGGGTGAGT GTTTGGTTAG AGTGAGTGCT TGGTTAGGGT GCATGCTTGG
TTAGGGTGAG TGTTTGGTTA GAGTGAGTGC TTGGTTAGGG TGCATGCTCG GTTAGGGTGA
GTGCTTGGTT AGGGTGAGTG CTTGGTTAGG GTGAGTGCTT GGTTAGGGTG TGTGCTTGGT
TACAGTGTGT GCTTGGTTAG GGTGCATGCT TGGTTAGGGT GAGTGCTTGG TTAGGGTGCA
TGCTTAGTTA GGGTGAGTGC TTGGTTAGGG TGAGTGCTTG GTTAGGGTGA GTGCTTGGTT
AGGGTGTGTG CTTGGTTACA GTGTGTGCTT GGTTAGGGTG CATGCTTGGT TAGGGTGAGT
GCTTGGTTAG GGTGCATGCT TAGTTAGGGT GAGTGCTTGG TTAGGGTGAG TCCTTGGTTA
GGGTGAGTGC TTGGTTAGGG TGAGTCCTTG GTTAGGGTGA GTGCTTGGTT AGGGTGAGTG
CTTGGTTAGG GTGTGTGCTT GGTTAGGGTG TGTGCTTGGT TAGGGTGTGT GCTTGGTTAG
GGTGAGTGCT TGGTTAGGGT GAGTGCTTGG TTAGGGTGCG TGCTTGGTTA GGGTGCATGC
TTGGTTAGGG TGAGTGCTTG ATTAGGGTGA GTGCTGGGTT AGGGTGAGTG CTTGGTTAGG
GTGAGTGCTC GGTTAGGGTG TGTGCTCGGT TAGGGTGAGT GCTGGGTTAG GGTGAGTGCT
TGGTTAGGGT GAGTGCTTGG TTACAGTTTG TGCTTGGTTA GGGTGAGTGC TTGGTTACAG
TTTGTGCTTG GTTAGGGTGT GTGCTTGGTT AGGGTGTGTG CTTGGTTAGG GTGCATGCTT
GGTTAGGGTG AGTGCTTGGT TAGGGTGCAT GCTTAGTTAG GGTGAGTGCT TGGTTAGGGT
GAGTGCTTGG TTAGGGTGAG TGCTTGGTTA GGGTGAGTGC TTGGTTAGGG TGAGTGCTTG
GTTAGGGTGA GTGCTTGGTT AGGGTGAGTG CTTGGTTAGG GTGCATGCTT GGTTAGGGTG
AGTGCTTGGT TAGGGTGAGT GCTTGGGTTT CCAGCAGTAT GCCAGAGACT TCCAAGCCAG
CCAGGACTGC AATGTGAGAC CCTGACTCAA AAATGAAAGA AAAACAAAAG CAAAACAATT
GTCTCTGTGT GTGCTTAGTT TAATCTTATC CACTCCACCT TCTCTCCCTG ATAGGAGACA
AATTTGGTTC GAGTAAAGCA CAGAGGAACT AATTAACCTG AGATTACTTG CAGAATAGCC
CTTCCTGACC CTTGAAGGCG CCATGTTATT ACACGTTGCT GTCTCTTCTA TCTACAGCTC
TATTTCTTCC TCTTCTTTAT TCTTGTGCCA GCTTCACCTC ACTGTGCCAT TGTGCCGGGA
GGGCAGTTTT AATGGCCACT TGCCTGCCCT CTCCTGACCT TGCGCAAGGA CCTGGGTTGA
GGGGAGGGCT TTGGGTGCCG TGGGCTCCTC GTGTTCCCAG GCCCTGCTGG GCCCAGGTGC
AACATGGTGG CTTCCCGCCC CGGAATGGGA GGAGTGGACT CTGCCTCTGT CATTCTCCAG
TCGGGGGAAG TGCTGGCTCA GGCTCTGCAA CCACAGTGCA GATGGGAGAG GGGCCATGGG
ACAGAAAGGC AAGGACCCTC AGTGCTAGCA GCTGCTGGCT TTGTGACCCA TACCCAGCCC
AGCTCCTGCC TCCCTCTTGG ATGGCAGGGA CAGTCTGGGA ACTTCTACCT GATCCTCACA
TCTATTCTCT CTTTCCAGAA GCCTCAGAAG GAGTCTCCCT GCCCCTGAGT TTCCAAAGCT
CCTCACCCAG GGGAATAAG GATGCCCATG CATAGCAAGA ACCTGTCACT TGCAGGTTGC
CTGGAAGACC CGGGCAGCTC ACAACTCATG CCTTGGACCT TAACTGCCTG TTTCTAGTTG
AGGAACCCAG GCTGAGGAAA CCAAGTTATA TCACCAAGAG CATTTATTCT AGCAAACCAT
GAAGGGGCTC ATGTGTGCCT CTTCAATACC TATGAAAAAT TTATAATAAA AATCCTATT
TAAAGCCGGG CGTGGTGGCG CACGCCTTTA ATCCCCAGCA CTCCGGAGGC AGAGGCAGAC
GGATTTCTGA GTTCGAGGCC CTGGCTGTCC CTCTACCACT GAGCCACATC CTTACTTAGC
CCAGATCCCG CCTTTGAAGA ATCGCAGTGT TTGGCTTCTA AATGACCAGG GTGACAGTCA
GACGAGGGAG TCCAGTGCTG CTGACCCGTG CAGCGACCCT AGCCATCAGG GCAAGGATGC
TGGCAGCCCT CCTCTTGACT CTTTTTCGTT CGTTCCTTCC TTCCTTCTTT TGTGTGATGC
```

Fig. 5-4

```
GTATTGTATA TGAATGTGGA TGGTGTGTGT ACACGTTTGT GGGTGAGGGT TGCACAGAGC
ATAATGGAGT CAGAGGACAA CTTCAGGTGT GCATCTGGCC TTCCACGTTG TTTATGAGAG
CATCTCTCTC TCTCTCTCTC TCTCTTTCTT CCTTTCTATT TTTTAAAACA TTTTGTTTTA
CATAAGTACA CTGTTGCTGA CTTCAGACGC ACCAGAAGAG GGCATCAGAT CCCATTACAG
GTGGTTGTGA GCCACCATAT GGTTGCTGGG ATTTGAACTC AGGACCTCTG GAAGAGCATC
CAGTGCTCTT AACCTGAGCC ATCATCTCTC CAGCTCAGAC AGGTCTTTTG TTTTGTTTTT
GTTTTTTCGA GACAGGGTTT CTCTGTGTAG CCCTGGCTGT CCTGGAACTC ACTCTGTAGA
CCAGGCTGGC CTCGAACTCA GAAATCCGCC TGCCTCTGCC TCTGGAGTGC TGGGATTAAA
GGCGTGCGCC ACCACGCCCG GCTTTAAATA GGGTTTTTTA TTAGAAATTT TTCATAGGTA
TATAGAATGC ATTCTGCTTA CTCTTCCACT TTCAATTTCC CTCCCGCCCT GGCCAGCACC
CCTTATTCCT TACAAAATGT CTCTGTCATA TTTGCTAGTT TTATTTTGTT TAGTGTTTCA
TAGTTCACCC CAGACATAGT TTGGGAACTA TTAAATACTC ATCAGTGGAT ACGTTGAGT
GCCCTGTGTC CCAATCCTTT AGTTGCCAGT AATAAATGGT AAGGTTTCAT GGGCTTCTTG
GAGTTGGGCC AATGCTATTT TCCAAAGATG TTAAGATTTA CCATAATAGA TTCTTGTACC
TGCCTCACTC ACACTCGCTT GCAGTACCTG TCTATCTTTC TCTTCTTGCC AATCACATTG
TAGATGAGGC TTTTGTGGTT TTGTTGGCTC CTAGTATTAG CATAAGGTGA ACTGATTTCA
GGTAAAATGT TGTGGCTTTT CTGGCCCATT CATTGGATGG AAACGAAGGC CCGGTTTTGT
GGGAGCACTT CTACTGGTTA GCAATGGCTA GGCAGAGCCA TGTCTAACAG TACAAACTCT
CTCCTGAGAG AATTAATCTT TCCTCCTAGA CGCAATTTTG TCACTTTGAA TTTTAGAACT
ATCAGAGGCC CCTTTCTCTA TTCAAGGACT TCTTGACAGC CATGTTCTTT CTTTTCATTT
CATCTTACCA GTACTCCCAC TTTTGAGCCT CAATATTTTG CTTCTCGTGA TCTTATTAGA
TTTGTGTTCT CATAATCTTT CTCCTGAACA ACTTAGGCTC TAAGTTATGA GACCTCAAAT
TACCCAAGGA ACTGGCTAGG CCTGCCTGGT GGTGTAGGCC TTTAATCCGA GCACTCCTGA
GTCAGTAGCA GACAGTGCTC TATGGATTTA GGGCCAGCCT AATCTACATG GACTTCAGGC
TAGCCAGATG GCCAGGGCAA CATAACCAAT TCATTACAT AGGGAATTAA AACTGAGGTA
TCTGGTATGA TAAAAGGGCC ACTGAGTTAG AAACTATCAT CTGAAAAGCA GGCTTAGTGG
TACAAGCCTG TAATTCTAAC ACAGGAGGAT CAGGAGCTCA GAGTCATTCC GGCTACTTAG
GGACTTGGAG GCTAGCCTAG TTCTGGCTCC ATGCAAAGGA AAAGGGGAAT GTGGCAGTGG
TTAAGATACC ATAATAGATT CTTGTACCTG CCTCACTCAC ACTCGCTTGC AGTACCTGTC
TATCTTTCTC TTCTTGCCAA TCACATTGTA GATGAGGCTT TTGTGGTTTT GTTGGCTCCT
TGTATTAGCA TAAGGTGAAC TGATTAAGA GCACTAACTG CTCTTCCAGG GGATCTGAAT
TACATTCCGG CTACACACAA GATGGCGTCT GTAACTTGGT TTCCTTGGGA TCCGACACCC
TCTGCTGGCC TACACGGGTA TAACACCCAA ACCTAATGCA TAGACAAAAC TCATGCACAT
TAAATAAAAT TTAAGGAAAA TATCATATAC AGCACATGAT GTTTTCAAAA CAAAGCATTT
TATTTAACAG CAAACTACCC CACCCACTCA ACCACCCACC CACCCACCCA CCCACCCATC
CACCCACCCA CACACGGACT CATTGTGACA TGTTGGTAAG CAACAGTTTT TTTTTTCAAG
TCTTCAAAAC ACCCAAGAGT CAACAGAAGT TCTGTATTCC GCATCCGTTC ACAAAGTCCA
GGTGTTTTCC ATGTGTTTTT TCACAGTTGG TGGAAGATG ACTCCAGTCT TTCAACAACA
GATTGGTACA CAGTTCATTT ATGTGATCAA AGCAGATGAT GGTAGGATGT GCTTAATTGG
TAGCAATATT GATGGCAGTA ACTGTGAAAG GAAGGCTTTC AGTTATTTTT TCCTTTGCAA
ATTCCAGAAA TGTAAGCCCA TTCCTACCCA TACAAAGGGA TATTACTGAA TCCAGCCAAT
```

Fig. 5-5

```
TTCCACTAAT TAAAAGCTAA TATTAGTAAC ACTTTTGATG CCCAATTGAG TTTAATGAAA
ATGAAAAAAA TTTGTTTGAA CTCCCAGACC TCTTCAACCT GGCTCCATCT TCTCTGTTCC
TTTTCTTTTG CCTGAATGTC CTGATTGGGT TACTAAGTAA AGTCTAGATA CTTTGAAAGT
ATGCGTATGC TACAATGAAT AAGCTTCCTT ACAGCAAATT GTGACTTCAG CTCTAAGGCA
ACTTGGATAA AGAGATCACA TTGACTTAAT CTGTTTCATT CCCATTTGAC TCAAGGCTTA
GCTGATAGCC ATTTAGATGA AAATACATTT TCAGAAACAT TTAGCGAATT AATACCAATT
TTGTGGAACT GCATTAAAGT CCCAACTTAG ATTCCAGATA GACAGGCTGG ACCCTTTCCT
TCACTCGGCC TCCTGTCCCA CCCTCTGTGA GTGAAAGAAA AATGGAAAGG GTCAAAGCAC
AGGCATTTTT AATCTTTTTC AAGTTCTTTC AATTTGGTCT TTCGTTCCTC CAGTTTTCTG
ATTGTTGTCA ATTTTATTAT TCTTAAATTT TATGCAAGAA TGTTAAACAT TAATGTTATT
TTCATCCACT GGCATTATTT TACCATAGCA AGCCACCTTG AGTATATTAT AGTAAGGAGA
ACATTTCTAA ATTACTGTGA GCATTAGCAT GTAAAAAGGT AAAAGGTTTA ACGACACAGG
CAAAATTGGT CAATGTATTT CAAAGCCTGC TGCAGCTCAA AAATGGCTTG TTTGCCCCAG
GATAATGCAA AGTAGCCTAA GATTGTGAAC TTAGATGGCT GTCATCCCTC CTGACCAGTA
GTGGTCACAG TCATAGCTAA AATGGCCTAG AAAATTGAGT TTCTTAGCGT GGAGGGCTTC
TGTAACTTTA GGGTCAGGCT TGCTACAAAG CCCAGCTTCC CACTCATTGC AGTGGCCGGA
GAAGACATGA GGATGAGGAC TCACATTGCA TATTACTTGG GGACTAAGGA CTAAGTCGTG
CCACTACCCA GAAAAGAGAC CCCCCCCCCC ATCCAGCACT TCCCTATGTC TATGTTTCCT
TTTTCCATGT CTCAGGAGCC AAGTGAAGGC CTAAGAGACA TGCAAATCCT TGTAGAACAG
GCGAACCAAT AAAGCAAATG AATGAATAAT AACCTTCCTG TATTCAACCT CTGAGGCAAA
CTGTGGGAAA TGAGGAAAGT GTTCTTCAGT CTAGAAAACG TTTGAGCTAA TATTTCTGTT
TAATAAAGAG CATCCCTCTG CTTTCCGGGG CATCTGTAAG TCACACTGAG TGCCCTTTTG
GAACAAATGT GTTGCACTTA GCATCCAGTA GCATCTTCTG CAATGTGTGG AACCGAGGAA
ATAGAGAACC TCTTTTATTA TTTCCACTCT ACCAAGCATG CCCATGAGGA GGGGAGCAAC
TTTTTATTTA ACTTGCCTCC TCTACACCTT GATGTTTTTC CCAGCTAAAG TGAGAGCTGT
AGTCTCAAGG TGTGACTGCA GTCCCCTCAG AAACTACTGA GGTAAAGTAC ACTTTGGGTT
GCATCCTTTA AATGTCTTTG TTCTTTTCAG TACTTAGAAA TTTTAGTACT TAGAACTGCA
CTTTCATCAC ACTTAAGTTA AAAGTATGAG TGTGATAGTA TATTCTTCTT GCTCACATGA
CGCTGAGCCA GGCAATGAAC AAATACGTTA GAATTATCGA TTCATCTTGA TTCTCCTTTG
AAACACTTCA ACAGTAAGAA AAGGAAAATG GGTAATGAAT TAAAGGACAG ACTTTAAGTC
TGTCCTGGCT TCAAGCTAGG CCAATGAGAA AATGACTTTT GGAGCTTCCT TAGCTAGGAA
GTCTCCAGTT TATGTTGAAG GAATCTTGGC CTTGGTTGGG TTTCGCAAAC AGCCATTATA
GTTAAAAATAT TTACTCAGAA GGCTGGAGAG ATGACTCAGT GGTTAAGAGT CTGACTGCTC
TTCCGAAGGT CCTGAGTTCA ATCCCAACA  ACCACATGGG GGCTCACAAC CATCTGTAAT
GTGATGTGGT GCCCTCTTCT GGTGTGTCTG AAGACAGCAA CAGCGTACTC ATATACATAA
AATATATAAT TCTTTAAAAA TATTATTCAC TCAGTAATCA GATATATTCT TCAGGCTGGG
CATGGGTTAA GCACATCTGT AATCTCAGCA CTTGAGAAGC TGTGACAGTC ACCAATTAGA
ACCAGCCTGG GCTTTATGAG ACCATGTCTC CTATGATCAG TGATCTACAC TAGGTCCACC
TCACATTTTA GTTTTAGGAC CTAGGTTAGC ATATTTATAT ACAATGTTTC ATTAGGTGTT
GTGTTCTGCA TGCTTGGTCC CTCCAGCCAG TACATCTAGT TCGAGAGGTT CTGGGCCACA
CTGAGTACAT GCCATCAGAT GCTCTGGCCT CTTCCCGTTT TGTTCCCTGA TACCCATGCT
```

Fig. 5-6

```
CTGGGATTAT CTCACTCTGG CCCTATAAAA CTCCTTTACT GGCAAGGTGT TTGTAATTCA
TCTCTGGCAG CAGCATTCAA CAAACATTTA GGAACTGGAT GGGAAAAAGT TCCTGTCATT
AATAAAACCT TTTCCACCTC CTCAGTCAAG CCAGCTGGGA AGTATCCTAG ACAGCATAGT
CCACTCAGTG TAACATTTAG CACACTGCCT TGCACAAATC CATTTTTTTT TTCTGTTTT
```

FRAGMENT 2: BEGIN XIST 3'

```
C
ATTTCCTCAT TGAAGTGAAT TGAAGTTTTG GTCTAGATTT CACTCCTATA AGTGCTACAT
AATGCTAGAA AGCAATCTAT GTGTTCGCTC AACACATAGC ATGGTAAAAT TATTATTAGG
TGGTGTTAGG TGATAAGCAT TATGATTAAG TTTCAGCCAT TATGAAACTT AGAAAGTAAT
CACTGTTCAC TGATAAAGCC AACAGTTAGG TCCCGGCTTT ATAGAACTGT AGACTTCACA
AAGCTCCACA CAGATCTGTT GTGCATGCCT GGGATAAAAG CAAAGTCATT GCACACCAGG
CAAATATTGC ATATATACAC ATATATATGG CAGTTTACAA ATTATAAATT AATCTCATGC
ATAATTTCTT TAGATACACA GGACAATGAG AATGCTCTTT GCATCCCAGT GCCTAGCAAG
GGCACTGTTT TGTAATAAAT GACTGCCATT CAGTATGTAC TCATCAAGTA TTGAATGCTT
CATATATTCA GTGGTTCACA GTTACTTATT TACTTTATTT TCACAGTATA ATAAATGTGG
CAGAATTTTA AAAGCCTGGA AATTGATACC AAGTAAGAAA ATGAATTGTT ATATTTATAT
GGTACCTCCG AGTGCATAAA ATGCCAACGT ACATATTATT CTCAAGTGTG GACACACTGA
AATGTACGTC TGTGTATCTC TCCAGTACCC ATGAAAGAGA ATATACACAT GGGAGACAAT
ATTTAGCCTC CAGGTTTGAG ATGGACCTTA TGGTCTTCCC AGGCTAGCCT CCAATTTCTG
GGGTCAAGTG GTCCTGTTGC TTAAGCTGAG AGCACATGCT AACACACCCA GGTTGTTAAC
TGTACTCTTC CCATTATGGG CTAAAAGTA CGATGAAAAT TTTGTAGAGA CTATGCCTAT
TTTATAGGCA GCTTTATTTC TATAGAAAAT TTGTCTTGTC TTATACTACT GAACTGCTTT
ATAGTTGAGA AGATACCCAC AACCATAATG TGACCTGGGC AAATGTTCTT GTCTTAACAT
GCCCTTATCA CTCAAGTTTT GACTGATTAA ATTAAGCATT GGCTCATTCA TTATGAATAG
TATGGAATGC AAACATTCTT ATTTCATGGC AGTTACTCAT GAATATTTCA TGTACCCAAA
ACAATATCGG ATACATCAGA GGTAGTTAGT AGTCATTCAT TTGCACACAT GGAACAATTG
ATAGCTGTAT AATGCTTTAT TTAATGCATT CTTTTGTAAA TTCTAGTTCT GTGGTAATGT
CCCCCTTTGT TATTCCCAGT GCTGAACATG GGTATTCAGA AATTAGAAGG TGATCAGAAT
AGGGTAATCA ATCACCTGCA TTAGTGACCT AGTTTGTAGT TTAAAATCAG TTTCCATGTG
TTTTCTCTTC TGCTACCTGG TATAATATAA CTTACTGAGC CTCACCAAAG CAGAAGAAAC
ACACTGGCCT TAAGTATATG GACTGTTATT CATTCAAGCC CCGTTATGTT CATATATTTG
TTTTTACAAA GCATGTTATT CCTAGAGCAA TCTTTGTGCC TATAGCACAC AGAGGCGTAG
ACTTTAGCTA CTATGTAATA CATACTCAGC ACTGACTTGG AAGTTACAGT AGGCTTCATG
GTTTACGTAT TCATACGTTT CCTGGTTACC TGGTAATATC TTGTTACCTG GGGGTGACCA
CAGTGAAGCA TCACAGCCTT AGTATTCAGC ACAAAAATA TGCAGGGAAG GAAATTAATG
TTACTCAGAC ATTCCCTGGC ATTCATATCA GGGCTTGATC AAGTCCAGGC AATAGACCAG
TGTGCCTTTT TCTTACCTTT TGAAAAGGAT TTGCAACTAA GGAATATGCA ACTAAGACCA
TGAACCCACA AAGCTTCAGG TACTTAGTCT GATGCCTTAT AGGAAAAGCT CTACACTTTC
AGATAATAAC CATGTATAAT TGCCAATGTG CTATGAGCAT GTAACTTTTT CATCCTGTGT
CATTTAACTT CCCTCTTACA GAGGAAGAGG AAGCACGAA AAAGATTAAG CCCGTTAAGT
AGTCCTTAGA GTCTCTCATC ATTAATTTTA AAGGTAGGTA TTAGACCCAG GAGTTCCTTT
GGTGAAATGC ACCAAATTAC TCGGCCACTA CTATGAGCAG GGAGTTCAGA CCTCATTTTG
TCCCCAAACC ATTATTAGAA AACCATACCC TGCTCACCTA AGCCCAAAGA AAGAAGGTGA
```

Fig. 5-7

```
CACTGGCTGG TGCTTCTCAG AGGGTTGGCA CATCTGCATA TTGCTTGTCT AATTCTTCTC
ATTGGTCTGG AACAACTCTT TATATTTTCT CTAGATAGCC TGACATTGTT TTCCCCCTAA
CAACCTGATG CTTTCCTTTT CTTGTCAGCC TAGGGCTTCT GAGGTAGGGA GGATGGCAGT
ATGCATATCT GTATGCATGC TTATTCCTAG GGAAGTTTCA ATAGTCAGGC TATATACACT
GGCTGGATTT AGTTCCGTCT CAAGTGGAGC AGATGTGAAG AGAAATGGAA GTTGTAAAAC
ATCAACAATT TAACAAATGG CTAAGACCCA GTTTAAAACA GACCCTTGCA CAATACTATC
CAGCTAAAAA CGTATTCCTT TATGGGCAAT GGCAACAATG AAAAATTACA TCTCAAGTGA
AGACAGCTTA AATAGAAATA TAAGAAATGG AAAGGGATGC TGGGGTTGGG GGGCAGGTCT
CATCTTCGAA TTTCCCTTCT TGGTCTTGGG GATAGAAGGA TAGAAATATC CTTCCAGAGT
TCTGGGCCAT AGGCCTTTAT CTCTTAAATA TTCTGTCCAT ATAGGATTGG GTCCTTAGGT
CTTATGCTTG GACTTAGCTC AGGTTTTGTG TCTTATGACA TACGTAGTTC CCCGCTCTTG
GAAGTCACAG GTGTCCTGTA GAAACAGTTC CTCTTCTTTG GGTTGTCAGC ATTCGTTCCA
GCCAGCTCAA GACGGGCCAT CTGTGTATTT TGGTCCTTTT AAATCTCAAG TCGCAAAACT
TCTGTCTTCT ACTTGGGCGT TCACTTCAGA GCCACTTGAA TCCTGACCGG ACGGAATGAT
GTATTTTGTC TTAGATTATT TCTCAGGGCA GTCTGGTGTG AGGAACGGCT CCACGGGTGA
CATTCTGGAC CTATTGGGAA GGGGCTATGA AGCTCCTCTC ACACATGACA CACATAACAC
ACATGCACAC ACGCACATGT ACATACAAAG AAACATCCAA GAAAGGATTA CTTTAGAATA
CAAGAGAGAC ACAGACTTGT AAAGAGATGA ATGCTCAAA GTGAACAGAA AGGAGGAAAG
TAGAAGATAG AAACACAAGC AAACACAAAG CAACAGAATG ATGCTGAGAT AAGAAATCCA
CCAATAGCAA AGAGACACAA AATCAAAAGA AAACAGAGAA AGTGGCCCAA GAAAGGCAGG
GAAGAAATGT AAACAAGAAT TCACTAAGGA TAGAAGCAGC AGAAAGAAAA CTGAAATGGA
CTGACAAAGA GAACTTGAAC AAAGAACAAG TGGGGTGAGC ACAAGAAAAA GAGAGGGATG
CATGCAACAT GTGACCCAAA GGGAGTCACG AAAGGCAGGA GTGAAGAAA AGCTAAGAGA
AATAGCAACC AGATAGATAA AACAGAGAGC CATAGCTAGT GAAGACAAAG CAGACCACAC
AGGCACCAGA GAAAGTGAAA CAAAGCTCAA AGCTCTGCAA GAAAGAACAT GCAGGAGAAA
CATGGGAATA GGTAAGACAC ACTGCAGACA GAAAAGACAC ACAAAGGAAA GAAGGAGACA
TGCAAAGGAA GGAAGAAATA GATGTAACAA AGAATTAGAC ACACAAGGAA GAAGTAGATA
CACAAAACAA GGAAGACATA GACACACAAA GCAAGGAAGA CATAGACACA CAAAGCAAGG
AAGAAATAGA CACACAAAGC AAGGAAGAAA TAGATGCAAC AACGAATTAG ACAACACAAG
GAGACATAGA CACACAAAGC AATGAAGAAA TATATATACC AAAGAATTAG ACACAATGCA
AGGAAGAAAT AGACACACAA AGCAAGGAA GAAATAGATG TAACAAAGAA TTAGACACAA
CTGCAAGGAA GAAATAGACA CACAAAGCA AGAAAGAAAG ACACACAAAA GCAAGGAAGA
AATAGATGTA ACAAAGAATT AGACACAACT GCAAGGAAGA AATAGACACA AAGCAAGGAA
GACAGACACA CAAAGCAAGG AAGAAATAGA TATAACAAAG AATTAGACAC AATGCAAGGA
AGAAATAGAC ACACAAAGCA AGGAAGAAAT AGATGTAACA AAGAATTAGA CACAACTGCA
AGGAAGAAAT AGACACAAAG CAAGGAAGAA ATAGATATAA CAAAGAATTA GACATAATGC
AAGGAAGAAA TAGACACACA AAGCAAGGAA GAAATAGACA CACAAAGCAA GGAAGAAATA
GATGTAACAA AGAATTAGAC ACACAGACCA GGAAAAAAT AGATACATAA AACAAGAAAT
AGACACACCC ACAATACACA CTCATTCTAT TGCTTTTAAG ATGCTGCAGT CAGGCATGTT
GATCCTCGGG TCATTTATAA AGCTGCCTTC CTTTTGTGTG TTCACATTGC TTGATCACGC
TGAAGACCCA GTTTTCTGTG CTGCTTTGGG GAAGGGTAAT ATTTGGTAGA TGGCACTACA
```

Fig. 5-8

```
AAGAACAAAA GAAGCTGTAT GAATGCCAGG AAAGAAGTAC TAGAACATCC TGGCTCTTTA
AATTCTGCCT AATGATAGAT ACTTCTGTAT CAATTCCAGC CAGGTTTCCA TTTGTAGTTA
GAGGCATTCA TCATCAGTAA TGTTAGTGAT GGCTCAGTGG TTAAGAGCAC CTATTGCTCT
TCCAGAGGTC CTGAGTTCAA TCCCCAGCAA CCACATGGTG GCGCACAACC ATCTGTAATG
AGATCTGGTG CTCTCTTCTG GTGTGTCTGA GGACAGCAAC AGTGTACTCG TAAATAGCTA
GGTAGGTAAA TAAGCTACTC ACTTGTGTAT TATATGGCAT GAGTAGGGTA GCAGTGCATC
TTGAAGTATG TAAACAGCTG GCAAAGCTTT CCTAGCTTCT GGAGAGAGAA CCAAATAGAG
CAGAATGGCT TCCTCGAAGG TCAGTGCCAC TATTGCAGCA GCTTTTCTCC TAGAAGAAAC
ATTTGCACTG TTTAGTTACA TTTCCAGAT GTGGGAAAAA GATAAAATTT ATGTATATAT
CTCAAGTAAA AGGCTGACTT TAATGGAAAA CAAGATCAAA GTTAAAATTA TTACACTGTT
GCAGAAAACT TACCTACTTT GATGTAGGGT GGCATTCTTT GAGCCTTTGT CTTCCTTGCT
GGGTTCAGGA AAGCGTCTCA CTGAAATCTG GCTAGGCCT GTTGCCCAGT GGTGGTGAGC
TATTCCCCTG GAGGATCCTC ATGCCCCATC TCCACCTAGG GATCGTCAAA GGGAATAGGT
CGCCAGCACT GCAAAGCAGC AAGCCCACAA TTCTGGGGGG AGATCTGGAA AAGAGGTGAA
AGAAAAGCCA ATTCTTGAAA TCAAGAATAC TGGGAAAGTT GTCTCATTAT GTAGTAACCA
GCAGTTGTGT TAAATCATGG GGAGGGGCTT GGAGAGTGAA CCCTTCACAT TTGTAGATCT
TAGTGTTAAC TTAGAGACAT GAGAATTGCT CCATCCAAGT TCTTTCTGGC TTTTATTCTG
TCACCTACCA ATGAGAGATC CTTTAGATTA TAGGTTGTGT TAAAGTCCTT GTACTTCAAA
TACTCTGGGA ATAAAGGGGT TAAATTATTT CTTCTTTTA ATTTGTGCTT TAAACAATAC
CATGCCAGAA CACTGGCAAG GTGAATAGCA TTGTTTGGCT CAGTGCTTAT GGTGCATATG
TCCCTAGAAA CTGGTGTAGC ATTGGACCTC TGAGTTTGAG GATATTCAGA GACCAGAATT
ATGACAGGCC TACAGAATGT GACAACAGCC ATATCTACTT ACTCTATCAA GTACAAAAGA
CTAGGGTGTC AGAAACTGGC CTTCATTCCT CTGATAACCT ACCTTTTAGG CATTTCAGAG
CAGAAATGTT ACAGATTGGT CATAACATGG TGGGGATGAT TTCAAGGCCT CATCATAAGG
CAAGGATCTC ATTGGCTAAC TGACTATGCC AGGGGACCAG GAGATGGGGA GTGCTTTATT
GACTTGCCCC CTCATTCTCT GATGAACTGG AGATCAGATA GAAACCCCCA AATAGCAAAT
TCTCCAAAGT ACCTTTTTTT CTCCATGTGG CCTGTAAGCT TTTTGTTCAG AGTAGCGAGG
ACTTGAAGAG AAGTTCTGCT GAGATGTAAT GTAGCTGTAT AGGCTGCTGG CAGTCCTTGA
GTCTCACATA GGGATTGTTT GTCCCTGTGA AGAAATACAA GGCTATCATT AGACTACAAA
AATTGTTGAA AATTCCACAT GAAATAATG AGGTATTTAC TTAGGAGGTA TAACTTGACA
CATTAGACCT TTAAGGGAAG ATACTATCTC AGTCAACCAA GTAACGGAAA TACCTTTGGG
CTCTCTCCAG CACTCTTCAC TCCTCTAAAT CCAGGCAATC CTTCTTCTTG AGGCAGGAGC
ACAAAACAGA CTCCAAATTC ATCCCTGGAA AACAAATGAT AATTATACTA AACTCTACAA
ATGATAATTT GATTACTAGC AATACAATCT TCATATGCAC ATGTCAGCGT TTTCAATTGG
TGGTAAGAAC TCAGGGTGAG GATATGTTCT CATGGAACCC CTAGTTCTTA AGAGATGTGA
AAACAGCCTT TAAAATTGAA AGCATGTCTA CATTTCAAAG GCCTTTCATT TCTTTTCCCT
TTTTGTATAT TTGAGTACTC TATCTGCATG TATGCCTGTG TGCCAGAAGA GGGAGTCAGA
CGTCATTACA GATGGTTGTG AGCCACCATG TGGTTGCTGG GAATTGTACT CAGGACCTCT
GGAAGACTAA CAGAACCATC TCTCCAGCTC TCGTCTTAAG TGAGCTTTCT CTTTTCCTGT
TTTATTTAAA ATTAACAAAA CTTTCTTATG ACTACACAAA TAGAGCCATC TTCCCCTGGG
ATGAGCCAGA GGACTAAGTA AGGGGCAGGC AGAAGAGGTT CACTGGACTG GGAGAGAGGG
```

Fig. 5-9

```
CACAGGTTGG ACAGTGGCTA GGTTATATGG CAGTATGCAT ACAAAGACCT GGTCTGGTTC
TGCCACAGGG CTTTGTAAAA TCAGCTGGCA AAATCCACTA CTTCCACTTC CCACCACTTA
ATGAAGGTGT ACATTCTCAA ATTCACTTGT TCTACAGGGT TCTTTGTTTA CAAACTCCTA
AGTCTGGGTC AAGCCATTGG ACAGCTTGGA AGAAAGCTCA TTCTTCTTTT TTTTTCAAGA
CAGGGTTTCT CTGTGTAGCC CTGGCTGTCC TGGAACTCAC TCTGTAGACC AGGCTGGCCT
CGAACTCAGA GATCCGCCTG CCTCTGCCTC CCAAGTGCTG GGATTAAAGG CTCGAGCTAC
CACTGCCCGG CTGAAAGCTC ATTCTTAATG TATACAGTTC AGGCAGCCTG AAGATGGTGA
TGGCGAGTTG GTGGCTTTCC ATTACATGAT TACTGACAGT GAGGGCTGGG TCAGGACACT
AATTTGGGGA ACTCTTTGTA TTCCATCAAT TATGGGGACC AAAGATGGCC TCCAGATGGT
TTTGTGTGAT GGCACCTCCT AATGGACATT TCAATCACAG ACAAGCTCAT GTTCCAGATG
TCCTACTACA AATAAGTGTG TATTTTACAG TGCCGTGGAG GTCATGTAGG ACTAGGTTGC
CATGACAGAA TTGGCCCTGA TTAATGATCT GCCTGCTCAC ACAACTTGAT CATTTCAATA
GGGAACTGTC AGTGATAGTG GGTTTACTGT GAATAGCAGC AGTACCAGCT TCCTCCAGGC
CACTAACTGG AGTCTGAGTC CTAATCTCTA TTTAGGTCCA TAGGAGGCAG GCTGAAAGCT
CTAGGTGCCT AGGCAAGCCT GGGGGGGGGG TCACTTTGCA TGTACTGGGG TGGGTAGCCA
ATGGTGCTAA GGTGAGACCG AAGCTTTAGC TAACTGTCTT AGTGCACCAA ACACATTCTT
TAGCATCTCA AAAAGCTTTT TTTCCTTGCA AATGTTTCCT TTTGAAGCAG TTACTTGTAC
AACAATGGTC CTAGTTTCCT AAAAGACTCA ATAGTTCTAG ATGTATTATC ACCTAGAGAG
CCAGACAATG CTAAGCCTTT GGAGTTGGGG GAAACCTGCT GCGAAGGAAT TTACAGTGGA
CTTAAAAGGG TTAAAGTACT AGAGGGTCAT TTGCACGTAC AAAAGGCAAA TGCAAAAAAA
TGTTAAGTGT TATGGACAAG GATGTTTTTT CAGCTAGACC ATTTTCTACA CAGGAGTCAA
GTATTTGTTG TTTTAACTGA AAGTATCTGT TGAAAAGTGC TGGCAGGGGT CCAGTGTGGC
ACCCACCCTT AATCCCAACA CTCTAAACTG GAGGCAGAGG CGGGCGGATC TCTGCGGGCG
GATCTCTTGA GTTTGAGTTC CAGGATAGCC AGACTACACA GAGAATCCCT GTCACAAAAC
AAAACAGAGA ACAAAACAAA ATTAATTGAT TAATTAATGA AAAAGAAAAA TGAGCAAGGA
GGGTACATAA AGTAGTCCAT AGTAAAATTT GTTCATAAAA CTTATCCTTC TTTGCACTTT
TGTAAAAAAA AAAAAAAAAA AAAAAAAAA AAAAGATTGT AAGCTATGAA GTTCTCTGTC
TAAGCTGTTA GTGCCGTCCA GTGGTCTGTT CTGGGCAGAA ATGCAGTAAA AATGGTTGAA
AGAACCAAAT TATCAAATTT ATATTCCCAA TTCCTACACA AGCTCATCTC TTGCTACCCT
TGGCGTACAG CTAAGCATAA TGCATGGAGT CTTTCACTCT TAATATTCTT TCCATGCTTC
CAAGAGGTAG ATAGAAACAG ATGGCATTCA GATAAACCAA CCAGATGGTA CTAATAGTCG
TCTGGACCAA CAAGGCAAAG TAAGCACACT TCCCTCTTTA AGAAGTCAAA TTTCAACCCC
AGTAGACTTC CTAAAATACT TAAACAATTC ACACAGGCAG TACATTTCCT AAAATGATCT
CAAGTGTGCT TATATTACAT TAAGTCTTAA ATAACATAAT CATCTCACGG AAGAAATTTT
GTAAATATC ATCGCTTCTC ATTTTAGTGT ACCCCAGCAT AATGGCGATT GGGTACACAA
TGTGTTAATT CTACAATTTC GTTGGCATAC TATGTGTTGT GTATGGATAA GCTGAGAAGA
GCTAGTGACT TATTAGTCAC TTTGACTTTT CAGTGGGTGG CACAGAAAGA AACTCGAATG
AGAAAAAGAT AGCTTAGTAG CTAACAAGGT AGTACTTACT GTAGTCTAAA CAGCCAGAGT
CTGATGTAAC GGAGGAGCAG TAGTTCAAGC AGGATCCTGC ACTGGGATGA GTTACTTGAA
CATCCTCCTC AGAAAAATAG TATCATTTCT CAGTAATGCT GGGAGAACTG CTGTTGTGAT
GATTATTTTC ATCAGCAATG TCATATCAAA CACTCAGCAG CGGGATGGCA AGATGGCACG
```

Fig. 5-10

```
CGGAGGGTAA AAGGCACTTGC TGCCAAGCCT GATGATCTCA CTTTGATCTC CAGGACCCAC
AAGATAGACG AACCAGCTCC CATTGTTGTC TGAGCACCAT GTGAATGAAT GACTGCGCGC
AGCAACATGC ATGTACACAC ACACATACAT ACACTCATAC ACAATAGCTC CCAAAAAAGA
CCTAAGTACT CGGCGGCTAC AAAGCACCCT TCACACTAGA GAAAGCTCTT TTCTTACTAG
GAAAATCTCT CTTTGAAGTG TACGTTTAAA GGAATGATTA GATCCTGGCA GACATATTTT
AAAATGTAAA GTGGGGAAAC AGGTTCTATC ATCTCTAAAA TAAATTCCCA CTTTAGGAAT
TTTCAAGCTA CTTCAAATTA TTGCCAGAGT TTAATGGTGG ATAGAATGAA TTAATTAAAT
GTGATGGCCT ATATAATTTT CAAAGGCGAC TTGACATGTT CTCAAATTTA ATCCATCCAG
TCACCTTTTA AAAATAAGCA AGGACTGGTG ACCAATGTCA GACAAAATAT AATGATTAGA
AGGCTTAGGT CATCTTCCAA AAAGTTAATC ATACTAAAGG CCACACAAAG ATTGACTTTT
TCGTTTTGTT AAACTTGTAG TAAAGACCAA GCAAAGATAC TTGTCTTAAA CATTCTGCAA
TAGTTGCACT GATCTTTCCA CAGACTCATC ACCCTCAGTA CACTGAGACA CTGCTTAGTC
TTCAGAAACA TGACACAAAT GGCTATTTTT ACTTCACAAA AGCTAATGAT CTCACAGTCA
ATCCACCTTG CAATCCAAAT GCCTTTCTTA AGGAATAAAA TTATCAATAA CTTTTCTGGC
AGTTGGTCCT GTACAGTAGC AATATACAAA ATCGGGCTTA AGTTTCTTA AGCAGACAGT
TGGCTCCTTC CTGGAGGAAG AATGGAAAGA AAAGTGCTAA GCTTCCTTCT CAGGAAGACA
ATTTTCAGTT CATACTGTAA AGGAAAGCCC CAAGTAAAAG GTGGCAATCC AACTCCCTGA
GCTACTTGCC TGCAATATTT TGCACAATAA AGCATTAATA AAGGTAGGCA AGAATGGTTC
CTGGCCCTAG AATGTGCCAG CAGTTGGAAT TGGAATAATT TAGAAGTGCA AGTTAAAGAT
TGAAGGCTCA TCCACCTAGT TTTGGCCTGC TTTTGCTATT CAGTGTATAA ATACACCAAA
ATTTATTAAT GACACATAGG GTGTTTGGGG TAATTAACAT TACCCAGAAT AATGTAAGAA
TTCGAGGTGT CTCTGTTCAG TGGGAGCAAG GAGAAGGCAA CTGAGACACT GTAGCCATAT
GAAGTGAGTA AACTGGTGTT GTTGACTTTA AGTCAAGAGA AGGGCTTTGC CCAGTCAATA
CTGTTCAAAC AAAGAGGCAA AAGGGATGGC ATGATGGAAT TGAGAAAGGG CACAAACTCT
TCCTTAATGA TGGGTTTGTG AGAATTAGTG ATTCAGAAAA GTGGTCAATG GACAAACTAG
TGGCCGGGCA AAAGGAACAC TATAAAGTGT GAGATTGTGA CTATTTAGGA TTGTATATAT
TAAAGCAATG CAAAAAGGGT CGAAATCCGG GTCATTGTTG GGTGTACATA CTGCTGTACT
TTATTATATC ATTGGGAAAC TAGCAGGGGA TTTGCTCAAG TTGGAGTAGA AAATAAACCA
TCCAGAACTG CCATTGTGCC TATTAAGAGT CCCAAAATCA GTTTAAGGAA GAGAGCAGGT
CATTCGTCAG AGCCCCTGTG CTCATTGACA GTACCGGGTA GTTTCGGGGG CTCAGCAACC
TCTGCAATAA TGTAAGGGG ACAAATATTC CAGACATTCA TAGTTATAAA TACGCTAACT
TAGCAATTAA TTCTGGGACT CAGTAGCCTT GATGGTATGC AAAGAGAGCA CACAGGTCCT
TGACATTTTT GCATAGTAAT CATCCAAATG CTGAGGTTAC TAATAGTTAC TACCACTCAG
CAGCCCCAGT CAAAAGGTAG GCATTTCAGA ACCTTTGCTG CCGCACAGGT CATATGTGTA
AGGGTACAGA TTAATATTGA CAAGAGAAGT GCTCAGAAAT AATTAATATG CCTCTGGTGT
CAAAAGAGTA CAAGGATGTA AAATCCAACT CCAAAGGTAA TGATGGACAA CTAACTGCAT
TAATGCACTT AAGTCCAAAT GAAGAGCACT TCGTACAACC CTCTTTCTGC TTTAAAGCGG
AGAAGAGGGT ACAGTAGTTC TTAGAGAAGT GCTTAGACAT GTGAACTTTC CAAATGAAAG
TCTTGAGCTT ATTATCACTT CCTGCTGAAG GTGCTAAGGA AGTGAGTGGG ATCCTTTCAA
GTGCACAGAG CAGGTGGCAG TGCATACGCA TACATTTAAT ATATGATAAC AGTCCAAAAG
AATGCGGCCT TGTTGATCAG CATATCCTGA TATAGTGCAA ATGAAAGGCG AAGGAGTATG
```

Fig. 5-11

```
GCCTTTGTTT ACTGGCAAAG ACAAAGGAAG ATTCACTGTA TATTAATGGT CCACTAGCAG
GGACCTTGGG AGATAAACGG TATCCCTTGC AGGAGTGCAA GAGATACAAT GGTCCGAAAA
GTAATAAGGT TGTGGATAAG TGTAATTTTA CACATTAACT GGCCAAGTAT TTTTATTAAA
ATGAATGGAT CATGTCCCTG TTATATACAT TAATGTTCAA GGGACATGTT ATCAATTAAA
AACCCCATCC TTTATGCAAA TATTAAGTCT TTAAAGTAAT AGTCCTGGAA ATTAAAGAGT
GGAAAGGAGG GGACAGCCTT ATCCAGTGTC CAGGAAGATG AAGAAGCCAA AAGATTAGTG
ACCCTTGCTG TACTGCAAAA GGGTTTGAGA GTAGGATCGT ATCCAAATGG AATGAGATGT
GTGCAGTAAA TGCATACTAA TATGCAAGGT ACATGTTTAT GGCCATTACA GTTTTACGCT
GTTCAGGTTT CCTTCTGTAG TGAACAGAAA AAGGCCTACT ACAATCAGTC ATTATTATTA
GCAAGCCACA AAATGGGACC TTATAGGTCA ACACCACTTC TGTACTTCAA AGTTAAGAGT
AAAATTGATC CTACTAAAAT TGCCAGTATG TACATAAATA GTTTGAGGAA GGGGTTTCAA
GTGCACAGCA CATACATAAT TCCATAAAGC AAAGAGGATA TGAATGATCA GAGACAGAAG
TCTTACCTTG AAGGACCATT GACCGTATTG GAATCGTTTC AATCTATAGT CTCATGAAAG
AAGCTTTATA TTAGTGAGCC TCTTTGCTTT GCTAAGTACA GGAGTCCTGA TCTAAAAGGC
ACAACTGTGG ACATGAGAAT ATGTACAATA GAGTTAACAC TGTGCACATT TACTATGTTA
AGGATCTTAA ATACTGCTGC AATACAAATA AGTCTTCACC AGATGCAGAT TACTACAGTG
AAATGACATA TGCACATTCA CAATATGAAA GACTGCATGC AGGGCATAGT GGTAGGAACC
AGATATGCCA ACACTTGTTA AACGCAGGCT AGATCCTGAG CTCAAGGCTA GCCTGGGTTA
TATGCTAAGT TCCAGGCCAG CCTGGAAGTT AAAAACAGGA CAGATCAAAG GTCTTCTTGA
TTACCAACAA AATGACTTGA CTTAGTTTGG TTTCTTTATC AATGCTTAG GAAGAGGGAC
AAATGCAGCT GTGCACACAA CAGGCACAAA TATGTTTACA TTACAGGTGG CAATGCCTGT
AAGTCCCGCC CAGCCCAGGC TACATAAGAG GCTGTTCTCT CAAACCACCA CACGGTGGGG
CTGTAGCTCT ATGACAGTGC TTTACTAGCG TACACAAGAC TCAAGGTTTG ATTCCCCAGC
ACAGCAGAAA GACCAGAACA GAGAAGTGGT CTCATTGGTT GGCACCCTTG ATTGTCACCC
ATTAGGGTAT GAGGGTATGG GATCTTGGTT ACTAACAGAA GGGGACTTGA ACAACTGCAA
TTTTGCACAA TTGTGTAAGA GGCATTAAGT AATCAGCACC CTCTTTACAT AAAGCAAGGG
TAGTATTAGG ACCTTGAGAA AAGACTCAAT TCCTAGTCAG GATTATCCAC ATAAAATGTT
CCAGTGCAGA GGTTTTTGGC TGAAATAAGA AAGCATGTGA GACTAGTATA CAATATCATG
AGCAAATAAA TGTATCTCCA TCAGTTAGAA AGATGTGACC TGGGGCGATA GCACCCATGA
CAGCATGCCA ACAGTATATA GTATTCTACC CCCTTTAATG GCCAATGCCT TGAAAATTGG
GACTGAGCAC TTTAACTGTC TGATAACAGA CCTGTGTTTG CCCCTTTGCT AAATGCACAC
AGGGCTGGAC TAGCTAAAGT CTAATCCAAT GGACAAAATA TTTCTGACAG AATTATTCAG
TACTCAAGGT AATACATGAG AAAAGACGAC TGAACACTGC TTAGAAACTT GGGACTGTGA
CTACTACAGC AATGACAGAA TGGTTTTCTT TCCTTAAAGG AAAAGGAGAC TTGAGAGATG
ATACCCTCCC ATGGCAAGTC TCTGATATAA AACTCTTGTT TGATTGGTGT ATCTTGATTA
ACATGAAGGA CAAGAGTTCT TTGTTTACTT GTCCATGGAC AAGTAAAGTA GGACTGTATG
CAAAGTGAAA TTCCATGACT CTGGAAGTCA GTATGGAGGG GTATGGGTA TAGATGGGCT
CAGTCTTATA GGCTGAGTGA TGGCACTGC ATTTTAGCAA TACGATTCTA TGCATTAAGT
GAAATTCCAT GACTCTGGAA CTCAGTATGG AGGGGGTATA GATGGCTAT CTCAGTCTTA
TAGGCTGAGT TATGGGCACT GCATTTTAGC AATAGAAATC TATACATTAT GTGAAATTCC
ATGACTCTGG AAGTCAGTAT GGAGGGGGTA GAGGGTATAG ATAGGGATAT CTCAGTCTTA
```

Fig. 5-12

```
TAGGCTGAGT GATGGGCACT GCATTTTAGC AATAGGACCG TATGCAAAGT GAAATTCTAT
GTCTCTGGAA GTCAGTATGG AGGGGGTATG GGGTATACAT AGGGATATCT CAGTCTTATA
GGCTGAGTAA TGGACACTGC ATTTTAGCAA TACGATTCTA TGCATTAAGT GAAATTCCAT
GACCCTAGAA GTCAGTATGG AGGGGGTATG GGGTATAAAT GGGCTATCTC AGTCTTATAG
GCTGAGTTAT GGGCACTGCA TTTTAGCAAT AGGACTGCAT GCATTAAGTG AAACTCCATG
ACTCTGGAAG TCAGTATGGA GTGGGTATAG ATGGGCTATC TCAGTCTTAT AGGCTGAGTG
ATGGGCACTG CATTTTAGCA ATAGGACTGC ATGCATTAAG TGAAATTCCA TGACCCTGGA
AGTCAGTATG GAGTGGGTAT AGATGGGCTA CTCAGTCTTA TAGGCTGAGT GATGGGCACT
GCATTTTAGC AATAGGACTG CATGCATTAA GTGAAATTCC ATGACTCTGG AAGTCAGTAT
GGAGGGGGTA TGGGGATAGA TGGGCTATCT CAGTCTTATA GGCTGAGTGA TGGGCACTGC
ATTTTAGCAA TAGGACTGCA TGCATTAAGT GAAATTCCAT GACTCTGGAA GTCAGTATGG
AGGGGGTATA GATGGGCTAT CTCAGTCTTA TAGGCTGAGT GATGGGCACT GCATTTTAGC
AATAGGACCG TATGCAAAGT GAAATTCTAT GACTCTGGAA GTCAGTATGG AGGGAGTATG
GGGTATACAT AGGGATATCT CAGTCTTATA GACTGAGTGA TGGACACTGC ATTTTAGCAA
TAGGACCGTA TGCAAAGTGA AATTCTATGA CTCTGGAAGT CAGTATGGAG GGAGTATGGG
GTATACATAG GGATATCTCA GTCTTATAGA CTGAGTGATG GACACTGCAT TTAGCAATA
CGATTCTATG TATTAAGTGA AATTCCATGA CCCTAGAAGT CAGTATGGAG GGGTATGGG
GGTATAAATG GCTATCTCA GTCTTATAGG CTGAGTTATG GCACTGCAT TTTAGCAATA
GGACTGCATG CATTAAGTGA AACTCCATGA CTCTGTAAGT CAGTATGGAG GGGTATAGA
TGGGCTATCT CAGTCTTATA GGCTGAGTGA GGGCACTGCA TTTTAGCAAT ACGATTCTAT
GCATTAAGTG AAATTCCATG ACTCTAGAAG TCAGTATGGA GGGGGTAGAT GGGCTGTCTC
AGTCTTATAG GCTGAGTGAT GGACACTGCA TTTTAGCACT GAATCAATGA AGATTCGAAT
TTCTCTAAGT AGAAGTGGGC TTGGGATAGG TCTGAAAGTA TCTGGGCCTG GGCTAGGAC
TGGGCTGGGG CAGGGCTGGA CTGGATTGGG TTGGTTGGGT GGGGCAGGGG CAGGGGCAGG
GGTAGGGGCT GGGGCTGGGG CTGGGGCAGG GGCAGGGGCT GGGGCTGGGG CAGGGGCTGG
GGCTGGGGCT GGGGCAGGGG CTGGGGCTGG GCCTGGGGCT GGGGCAGCAA TAGCAGCAGC
ACTATTTGCT GAGTCTTGAG GAGAATCTAG AGCCATAAAG GCAAGAACAC ACAGAAAGTT
GAAATGTAGG CCTTAATATT ACTATTATAA CAGTAAGTCT GATAGAGGAC ACAGAGCATT
ACAATTCAAG GCTCTTGCTG ACAAGTAAAA CCATTAGTCA ATATAGCATC AACAATAGCA
ACAAAAGCAA AGCCTGAACT GGTATAGAAC CTCAAATACT CCTGACATCC AGTCATAATG
TTCACTTTAC ATTAACAGTA TCTGTGTTAT AAGACTTAAA AATTTGAAGA GTAGCTCGGT
GGATGAGTTT GAAAGAAAGT ACATTAAGT GCCAAGTAAT TTGAGTATCA TCTGCCAAAA
AAATTATTGA AAACTTTAAG GACTCCAAAG TAACAATTCA CTAAAGGTAA TTAAAATGAA
TTCAACAAGT AAGCAAATCC GTAAATACAT TTTGAAAACA ATCACTTCGG TTTTAAATTC
AAACACTAGC AAAGCACACT ATCAGACGTG TCGTTGGCAT CCAAAATATT CATTGAAATC
AAAATGCAAC CCCAGCAATA GTCATGGGGT AGATTTTGGA AGAAGGTAGG ATTCTACCTC
TTCACCAGTG ATTTGTGATC CACTATGACT CTGGCCAAAG TCACCACTTA TACCCAGTAG
GCTTAGAGAA CCGCTTGAGA TCAGTGCTGG CTAAATAGAG GCCAAGGTGT AAGTAGACTA
GCCACTGAAC AATACAAAGG AATGGAACGG GCTGAGTTTT AGTTTGCACC GCCACGTATA
GAGCACTGTA AGAGACTATG AACGCAAGCG GATGAGTCAA ATGTCCTTGA AATGGCCTTA
GATACTTTTC TTTCTTTTAA TAGGTGAGGT TTCAATGATT TACATCGACC AAGAACCCGC
```

Fig. 5-13

```
AGCCTCGGTC TCTCGAATCG GATCCGACAT CATCCAACAC TTCAGTGTTA GAATTGCAAG
CATGCGCTCT CCCGACCTGG GCAGGCACTT CGAAAAAATG ATGACTAAAG ACACACGTGA
AGTACCAAGC GAAACTCACG TCCTTATGGG ACAGTGACTC ATCACAGTCT AATTCCATCC
TGGCCACCAA GCAATAATGC ACATTTCTAA CTGGAAGTCA AGCAAACACC AACACTTTCA
CACTTGTGCC CATTTCTGAC GAGTTACGTC AAGTGGCAAC CAACACTTCC ACTTAGCCTT
GCCTCAGCTT CGAGTGGCAC AAGGTAGGAC CAACCACACC CTACCATAAT GCACCAAGTG
TACCCTCGGG CAAAGCCCGC CAAGTAGCTA AGCCCGCCA AAAAAAAAT CACTGAAAGA
AACCACTAGA GGGCAGGTCA CATGACTTCC GCCATCTTAG ACACATTCAA GAGCATGTGC
CACCTCTCCA GGCTAACTCA GACATGAAGC TGACATGTGA CACACAAAGC CCTTTGCGTT
ATACCGCACC AAGAACTTGA GCCGCCATCT TTTCCTGTAC GACCTAAATG TCCTATAATC
CATTGCTACA CACCAGAACA AAGATTGGGC TGTCGAGCCT CGGGTGGAGC CCCCGAGCCG
CCATTTTATA GACTTCTGAG CAGCCCTTAA AGCCACGGGG GACCGCGCCA GGGGTCCATA
TGCACACACA CCCTGCCCAA TCCCCACACC CACGCTGAGC CCTATCCCCT AGTCCTCTGC
GGCTTCCGCG CAACACCGCA CACTAATACG AGCACTCCTT GGCTTTCTCT TCCGGCTAGC
ACAACCCCGC AAATGCTACC ACAAATCAAG GCGAATCCCG CAACCCCGCA CATATAAAGA
AAGCCTTTAG CTAGCGCAGC GCAATTGGTT GCTTTTATCC AGTCCGCTGT GCTCCTCGGT
GTCCTAATTC TTGGCGTAAC TGGCTCGAGA ATAGCCGTAT CACGCAGAAG CCATAATGGC
GGACGCGGGC TCTCCACGCC CTGAACACCC ACTCAGTTTA AGAGCAAAGT CGTTTTCTA
AGCCATAGGT TCACTCACAC AGCACCAAAC GATCAGCAGC AACAGTACAC GCAAATAAGA
GGCATAGATA TTCCAGGTAG TGCAATAACT CACAAAACCA TATTTCCATC CACCAAGCCC
CGTTGGGCCT GTAAAAAAA AATTTAAAGC AGGTATCCAC AGCCCGATG GGCAAAAGAA
AAAGAAAAAA AAATAATAAC AGCAGGTATC CGAGGCCCCG TTGGGCATGG GAAAAAAAGA
CTAAACGCAG GTATCCGAGG TCCCGATGGA CCGAGAAAGG TTTTTTTTTT TTTTTTTTTT
TTTACAAAAA GCAGGTATCC ATGGCCCCGA TGGGCTAAGG AGAAGAAAAA AAGAATAAAA
GCAGGTATCC ACAGCCCAGA TGGGCAAGTT TAGAAAAAAA AATAATAAGA AAAAAAAGA
ATGAAAAGGC AGGTAAGTAT CCAAAACCCC GTTGGGCATG GAATGGCGGG GAGGACACAC
AGGTATCCGT GGCCCCGATG GGCAAGATTA TATAAACAAT GAAAGAAAGG TAAGTCCACC
ATACACACAC AAGTATCAAC CAAAAGGCAC AACAAAGAAA TATTCCTTAA AAATGAAAAA
TTGACTGAAA ATATTACAAA TATCAAAAAG TATGGAGGAC ATGTCAAAAA AAAAATCTTA
CCAGAACATA TCAAAACGTC AAAAATCTCG TGGAATTTTG ATATGTTTTC TTAAATAAGC
CATAAGGCTT GGTGGTAGGG GAACTAAAAA TGTTCCCCCA AAGCTCCTTA GATGGAGAGA
AACCACGGAA GAACCGCACA TCCACGGGAA ACGAGCAAAC A
```

FRAGMENT 3: XIST PROMOTER REGION
```
GGCTGGAGC AAGCCGTTGC
ACGCCTTTAA CTGATCCGCG GCGCTGAAGG CGGAGAGACC AGAAGAGGAG TGGCCACAAA
GATTGCAATT CTGACATCTT ATTGGACCTT TAGGTCTAAC TATATTATAA AAAAATTAAA
ATGAATAAAG ATGGAGGTAC GTAAGCTCAG TGACATGACG CGTGAATTTC ATTATTTTGC
GCGATAATGA AGGATTATCC TATTTTACAG CTAAAAACGT TTATGTAGAA CTTCACATAA
ACATTTGGGT GTGTACATTT AGCACACACC TGTCTATGCA AAATTTCAAT ATATCTTCTA
CTTGGACAAA CCATGTGTCG CTCCGGTCTT GGACACTAGA AGTTCTTCTG CATTAGTTGG
CGACCTCAGA TGAGGAGAGG AAAGGGTAGA AATGCCTCAC AAAATGGCTC CTTGGTTCCT
AAATTATCAG AGTATTAGTT GTGACCGATT TGGAGGGCTT ACGCTCATAG TTTTGGGTCA
TTGGCATCTT AGTCTTTCTC TGGGAACCTG GTGACTCCAT ACCTTGGGAC AAAAACGCAC
```

Fig. 5-14

```
TGAAGACGTT ACTAGCTAGC AGTAATGAAA AATAATTCCT AAATGCCAAA GCAAAGCCTT
AGGGAATAAT AGCTCATTGG TATCTTACTC GCCCCAGAGA CACTGCTAAC TTAAAAGAAC
TGTCAAATTT TGTTAACTGT CAAACTATGA ATATCCACAT GAAAGAGATC AGACACCCTG
GGTATTAGAA AATCAAAGGA TATGTTGTCT CGTTGATCAC GCTGACAAAT AATTCACAGT
CTGTTCTAAG TTCCCTTTAG GCGTCCCATG AATAATAAAG GACACAAAAT TGGTTTGCTT
ATGGACGATC AAAGTGCCAG CAATTCAGTA ATCTTACTAT TGAGGTGGTT CAGGTAGGGA
TGGAAAAATA TCTGCTACAA AATAAACAGT TTCAACCAAA AGAAAAACAA ATTAACAAGG
TAAATAAATG ATGCACACAG ACTGAATAAA CCAGCAGGTG GCAGCATGAA TCTTTCCAAG
GCATCTGAAG CCAAACTTGG AGTGCAAAAG GATTCCTATC TGAATTGAGA AGTAAAGGTT
ACTTTGTCTA ACTTTAGTTG ACAGAGCGAT CAGGATCAGA GTAACAAGCA CACCAAAAGC
ATCACCAGTG AGAAGTCACA TAGGACATAT TAGGGAAAAA AGACCCAAGG AAGGGCTCTT
CACAGCTAAG AGCACCTGGC TCCACGATGG ATATGGCTTT GTATAAACGA GAACTTCTAA
ATGAGCTGTA CAAAGAGAAT TTAGAACTTG CGAGGTACTG GTCACAGATT ATGCAAGCCA
GTGTATCATT TTTGTGGGGA TGCTAGAGAG AATCATCAAA TTAAAGAGTT AAATTTAGTC
TCTGTGTTTT ACTTAGTCCC AATTCTTGCA AAGGTCATCA TTCTTTCTCA CACCGTGTAC
ATCAAGGTAT GTCAGGTTTC GGGGACACTT TTTAGTCTTA TCACAAGAAA GCATGAAGGG
ATATGTGCTA AAACTCAGTT CCTGGGCTGG AGAGATAGCT CAGTGGTTAG GAGTGCTGAC
TGCTCTTCCA GAGGGCCTGA GTTCAATTCT CAACAACTTC GTTGTGGCTC ACAGTCATCT
GTAGTGGGGG ATCCGATATC TAACCTTCTT CTGATGTATC TGAACAGTGA CCGACAGTGT
ACTCACATTA AATAAATATT TTTCTAAAAA ACACCTCCAT TCCTGTACAC TTAACTAGGT
AATTTATTGC ATAGCTTTGT TTGTTTGTTT GTTTTGTTTT TCAAGGCAGG TTTTCTCTGA
TATGCCCCAG ATGTCCTGGA ACTCACTCTG TAGACCAGGC TGGCCTCGAA GTTAGAAATC
CACCTGCCTC CACCTCCCAA GTGCTGGGAT TAAAGGTGTG TGCCACCACT GCCTGCCTCA
TTGCATATTC TTAACATTAA GATTAAAAAT GCACCTGGGG TAAAATAGTA ATCTTGAGGA
ATTCTCCATG CAAATTCAAA GAGGAGAAGA AGGAAGAACA AGATGATGAT GATAATGGGT
CAAGAAACAA GGACCCACTA CAAAGCAGCA AGAAACAGAA ATGGGAGTTA AGAAATGGTC
TTCCAATGTG CAGAGGTAAG AGACTTTAGA ACACTTGGTC CTAGATGAGA TGTCTTCATC
AAGCCCTTTC TTTCAATGCT CAGGCATCTA TGAAGATAAG GAGTCAGAAA GACTGCAGAC
AAAACAGCGC AGTTTTCGTT TTGTTTTTAA GAAAATGAAG TATGGATTTG GATGAGTGGG
GAAGAGTTGG AGGAAGGAAA AATGATCAAA ATAAATCATG AAAAATGGTT TGTTTTTTTA
AAGGAAGGAT GTTCAATGAC ACTACTGGCT CTGTGAACAG AGAGAAAGTT GGAGCCACAA
CTATAGGTGA TCAGGCATCC AGTCTCTCCA GGAAATCTAT ATTTTTTTCA ATTCTAACGT
ATATTGGGAG AGGGGTTGAT CTGGTATAAA ATGGTTGAAG AAACACTCCC AAGTTCATGA
ATCAACATAA TATTGTCTAA GTTGCATCAA AAACCCATCT ATGGATTTAG CGCTATACTC
AGCAAAATTC TAATGACATT CACATAAATA GTTTTTAAAA ATAGGTGACA TGGTAAGTAG
CTTATGCCTG TGAATCCCAG CCCTTGGGAG TTACAAGGAT GTAAGCTTCA AATGAATGAA
CAGGTTGCAC CACAGCGTCA ACATGCTACT GCTCATAGGT AGGCTTGTAA ATTAGTGGGA
TAGAATAGAG GACCTGGAGA CAGCCATCCA CTACTCAACA AAGGTACAAA CACCACATGT
AAGAGACATA CAGTCACTTG GCCAAGTGAT CCTTAGCATA GTGGTACTAT CTCACCCTAT
ACAGAAATCA ATCTACCAAA GATCATGTAA GAACAATGAC TCCTACAGCC TCAGACATTT
TATCACTAAG CCATCAGGAG CGGGGAGGAG GTGGCACTAC TTTAGAAGAA TTAGGAAGGA
```

Fig. 5-15

```
CATAAGTCAC TAGGGAGTGG GCTTTGAGGT TTCAGAAGCC CAAGCCAGGG CCGGTGGTTG
GCTTTCTTCC TACTACCTGT GGAACCAGAT GTCAAACTCC AGTACTATGT CTTCTTGAAT
GCTGACATGC TCCCTACCAT GAAGACAATA GACTTTAACC CTAGAAAATA TTAGAAAGCC
CCTTTACAAT GCTATCTCTT AAAGTGTGGT CAACCAGGTG GACGTGGTGC ATGTCTTTAG
TCCCCAGACC TAAGAAGTGA TCAATTATGG TGCTTAAGAC TGCTCTTAGA TTACTCTTGA
GATGCTTAAT ATTCCAGATG ACCAAAGTTC AAGATTTACA CTCACACTAG ACAAATCTTT
ACTGGCTGTA ATTTCAGTGC TAAGGGATCT AAAGATCAGG CTTTCATGTG CAACTTCACA
GACTTTATTT TAAGATAACA AAAAACAATC TCCAGCACCT CATAAAACAG GCATACCAAC
TTATAAGTTA TAGTAATAGA AAGTGAAGAG TCCCCAGCTC CAAGTCCCGG AAAAATATCA
ACAAAATCAG AAGAAAATTT TCCCAACCTA AAGAGATGCC ACCCTTTCCC CTGGCTGGCA
GCATGGAGGC TGAACGATGC CTGAAGTCAC TGTAAAAGAT GTTAACCATC AGGTTCGTCA
GAGCGCTGGC AGCCTTCCTC AAAAAGTCCA GGAAGCTGAA AGTTCGGGAA TGGGTGGACA
CAGTCAAGTT AGCCAAACAT AAAGAGCTTG CCCCATATGA TGAGAACTGG TTCTACCCAC
GAGCTGCTTC CACAACTCCG GACCTGTACC TCTGTACACA ACTGTAGTGC AGGAGTTGGT
TCCGTGACCA AGATCTATGA AGGATGGCAG AGGAACGGTG TTAGGCCCAG CCACTTCAGC
AGAGGCTCTG AGAGTATGGC TTGCCAGGTC CTCCAAGCCC TGAAAGGGCT GAAAATGGTG
GAAAAGGGCC GAGATGGGGG CCGCAAGCTA ACACCTCAGG GACAGGAAAC ACATCTGGAC
AGGATCGCTG AACAGGTGGC AGCTGCCAAC AAGAAGCATT AGAAAAAATA ATACTGGGTT
AATAAATTGC CTCATTCATA AAAAAGAAAA GAATAAAGAA AGAGAAGCCT ATAAACATAC
CAGAAGCTTA TAGAGTACCA ATTATAACCA AAAAAAAAAA AAAAAAAAAA AAAAAAACCA
AACAAAACAA AAAACAAAAC CCTCCTGGCA TGTAATAATC AAATGTAAAT ACAAATAATA
ATGTTTTGGA GAAGATGTAA TGATCCATTC CATTAATACG AGCACTTGGG AAGCAGAGCC
ATGGTGGATG GGTCTCAGAG GAGTGTGAAC TTAATGTGGG CCTCTGCTGT AGCAGCAAGT
GTTCTTAGCT GCTAAGCCAT CTCTGTGGCT TCTTTTATTC CAAGGACTGT TTAAGCTGAC
CTGGAATTCA CTATGTAGAC CAAACTAGCC TTGAACTTAT GGTGAACTTC CTGCCTACAA
AGTGTTGTGC TTACAAGCAT GTGCTACCGG TCACAGATAT AAGTGATAAG TATAAGTGTT
TTATTATATA TAAATAAGTA AATAAATACA TAGATTCTAT ATCTGTTCTT CCACTTGCCA
CATCAGTTTT TCCCCTCTCA GCTCATACTC CGGATTACAT ACTCCGGTGT TATAGTCTTG
GCACAGGAGC AGGCAATGCA AGTTGATGGT CACAATTATG CAACCTGAGG AATCCTCAGA
ACCGCAGAGT TCTCTCTAGT TATATATTGT TGTGATTCTT GATTTATATT ACAGAAAACT
TAAGAATGCT TATTGAATAA GATGAAGGAA AGATATGAGT GGGTATTGGG AGGGGCATGG
ACTGAAGTCC AGCAGTAGTA GCTATATACC TGATTTGTTT TTTTTTAAGT TTCTGTTATT
TAAAGGAAGT ATTTTATAAC CAAGGTTGAG AGAGCAAAGA AAACATTTGT TCATCTTCCC
ACTCTACCCT TGCCTTTTCC ATTTTTGTGT GTATATGCAT TTTGTCCATA GATGTGGATA
CACATGTATA TAGGTTCATA TGTATATGTG TGTGAATATA TAGGCCTAAG TTTAATGTCT
TCAATCATTT TTCTACCTTG TTTACTGAGG CAAGATCTTA GCCAACGAG AGCTCACTGA
TATGGCACGT CTTGTTAGGC AACTTGCTCT GGGGATCCCT GTTTGAGCCT TTCATAGCTG
CAATTATAGG AGGGCTTCAC ATGGGTTCAC GCCTTGGGGA CTTGAACTCT GGTCCTCATG
CTTTTATGGC AAATACTTAA CCTCTGAGCC ATCTCTTTAG ATCCCCATTA CATCATTGAA
AAGTATTGAG TTTTTAAGGT TTATTTCTGA CTTTAGTTAT GTATATGGTC TGTGTGTGCC
CTCAAAGACC AGAAGAGAGC AGCAAAGCCC CTGGAGCGGA AGTTATAGGT GGTTGTCAAC
```

Fig. 5-16

```
TGCCTGATAG TGCTGAGAAT CAAACTTGGA TTTTCTGAAA GAGTAGCAAA TGTTTGTAAG
CATCGAGGTA TGTCTCTAGT CCCAGGTTTG TTTGTTTGTT TTATTTAAAT GACGTTACTG
AGGGTACTGG TGAGGTTGCA ATATGAATAA AAGAGATGTG ATTAAGATAA ACCCATGGAA
TGTGAGCAGT GGAGGTGCAC ACCTTTAATC CCAGCACTTG GGAGTTAGAG GCAGATGGAT
CTCTGAGTTT GAGACCAGCA TAGTCTACCG AGGCAGTTCC AGTATAGCCA AGGCCACAGA
GAAACCCTGC CTTGAAAACA AACACAAACA AACAGAAAGA GTAGATAATA ATACATTTGG
GGGGCTGGAG AGATGGCTCA ACAGTTAAGA GGATTCGCTG CTTTTCCAGA CGATCCAGGT
TCAGTTTTCT TTAAAGAATA GGCCACTGGC AGTTTGACCT CACGAGCTAA TAATGTTTTA
TATAACATGG AGTAACTTAG AGTAGCATAA CCTGATGACA AAGGTGGTCA AGTGGTAAGA
GCCATAGAAG GGTTCAACGA CCCTGCCCCT ATCGCTGGAG TATTGAGATT TAAACTAAAA
ATAGGAGAGA CATTTCAATA GAGAACAAGG AGTACCCATA ATAAGTAATT TTCGCTTTTT
TCCCCTGCCG CCACCAATTT GCGCGGAGGC AGAAGCTCAG GTGCGTTCAA GATTCGGCGT
CACCCATAAT CCACCGCCAT GGCCGAGGAA GGCATAGCTG CTGGAGGTGT AATGGACGTC
AACACTGCTC TACAAGAGGT GCTCAAGACC GCCCTCATCC AGGATGGCCT AGCACGTGGC
ATACTCGAAG CTGCCAAAGC CTTAGTTAGA CAAGCGCCAA GCCCATCTCT GTGTGCTCGC
ATCCAACTGT GATGAGCCCA TGTATGTCAA GCTGGTGGAG GCACTTTGTG CTGAGCACCA
AATCAACCTG ATAAAGGTTG ATGACAACAA GAAACTAGGG GAATGGGTAG GCCTCTGTAG
AATCGATCGA GAGGGGAAAC CACGGAAGGT GGTCGGTTGC TGTTGCGTAG TGGTTAAGGA
CTATGGCAAA GAATCTTAGG CCAAGGATGA TATCGAGGAA TACTCCAAAT TCAATAAATA
AATAAATTGT AGCTCATTAT GAAAAAAAG TAATTTTCTT CGAGGTGTAG CCTGACTAAT
TATTGTGTCT TGTGGTACTG CAAGATAGCC CAGAGAAACC CTCATCTTGA CTGGCCATGG
TAGCACATGC CTATAATGGG AGCAGAAGAA TTGCTTTGAG CTTGAGACCA TACTATGTCT
TGAGAGAGTT CTTGTTTTTT TAAAGGGTGG CTCATGTTTG AAGCATAAGC TGATTACTTT
TGCCTTGCAT CATGGATAAC TGCCCTCATA TGGAAGAAGG TCTGTCCTGG GAGGTTTTGC
TCTTGGAGTT CAACATGACT AAGGATGAAT GAAATAATTT AGGAAGACAC TCCTTCTGTT
ATTAATATGC CTATGCACAG TCAAGCAGGA GTTTGAAATG AACGGAAAGA CAGACTCAAA
ATGAAGGCAG AGACTCAAGT CTTTAATCCT GTGGTTGGTT ACCTTGTGAA GCCAAGTAGG
CCATCAATAC CTTTAGCAAA AGCACTTTCT GAAAACCTGT TCTAACAGGA CATAAATTTC
TAACAACAGT GCAACTTAAA TTGTAAGAAA ACACAGGACT GTTTCAAAGA CTGATAGCAT
GTTGTTTCCT ATGTTTCATA TACAGCCTCA TGGTTTGCTT TGGCTTTGCT CTCCACCCCT
CTTTCACGTG GTCTCATGTA ATTCAGGCTG ATCTGGAACT TACTGTGTTG CTGAAGATGA
GCTGAACTCC TGATGCTCCT TCCTAACTCT CTCAAATTCT GGAATTTTAG GCAAGCACCA
CTTTGCTCAG CTTTTCTTTG ATTTTCATTT AGAATATTAA AGAATAGTTT TATTTAATCC
CACCATTCAG TAGGCAGAGT CAGGAGGATT TCTGATTCCC AGTCTGGTCT ACAGAGCAAG
CTTCAGGACA GCCAGGGCTA CACAGAGAAA CTCTATCTTG AGATACCAAT AAAGAAAGAA
AGAAAAACAT TTTTCTTGGG GCTGGCAATA TGGCTCAGTG GTAGAGCAAT GGCTTAGCAT
GTAATTAGAA AATCATGGAT TCAGTCCTTA GTAACACACA CACACACACA CACACACACA
CACACACACA CACACACACA CACGGGCTGA GTCTTGACTG CAAGATGGCT CAGCTGATAA
GGAGCTTACC TCAAAGCCTG GCAGACACCC TGAGCTCCAT CCTTGGAAAC TATGTGGTGG
ACACATCCAT ATATTCTCTC TCTCTCTCTC TCTCTCTCTC TCTCTCTCTC TCTCTCTCTC
TCTCTCCCTT CTTCTACCCC GCCTTGGTCT TTCTCAAACA CAAAAATAAA TAAATGTAAA
```

Fig. 5-17

```
ATATTGTAAG AAGTTATAGG TCATTTATAT AAAGAAAATT AAAGGAAATT AAGGAAATAC
TTTTAGATGA GAATAGAGTA TAAGGTTTTT ATCCTAAAAC TAAAAGATTG TTCCCATATG
GACAAAAAGG GGTGATGAGG GAAAAAACCA GAAAGTTTTA GTCTATTGCC AAAGGCCTGA
GTATGTCACA AGAAGTTTGT AGAAGATAAA GTGAGGCCCG GGGAAGGAAG GAGAATTGGG
AATTTACAGT CATTCTCTGC TACGTAATAA GTCGAGGCCA GCCTGGAATA ACGGGGGCCC
TGTCTCAAAA ACAGAAGAGC AACAACGATA TGCATGCCTG AAAAGCCAAA TCTTTAAAAA
TTAGCTAGAG TCACACTTTC CTAGGTACTT CTTTCAACAG TTTTGCCACA GACATTAGAA
TGAAGTTGGA AATGCAGACA GTTGGGCTCC CAGATACCCT GAATCAACTT TTATATTTGA
CTTTTGTTTT TTTTAAGTTT ATAAAAACTT TTTTTTTTTT AGAATTTTTA TGTGTGTGAG
TGTTTTGCCT GCATATAGGT CTGTGTACCA CACTCGAGCA TGGTGTCAGA GGAGGTGAGA
AGCCTCATGC AGCTGCTAGG CATTGAACCC CAGTCCTTTG TGAATATT AAGTACTCTT
ACACACCAAG CCAACTCTCC AGCCCTGCTT TTGGGGTGTT CAACAACAAA GATAAGTAGA
AACCAAATAC GCACCCAGAG AAAAATCACA TATATACAAA AAGCCAGAAA TTTGAGAGGC
AATGTGTGTG TGTGTGTGTG TGTGTGTGTG TGTGTGTAAT AATTTTCACA AACTTGCCAT
CTCAGAGAAA CTCTAGGAGG AAGAAAGGAT TCCAAACAGG CAAATTCTGG CTACAGCTGA
GGAGAGCTCG CACAGGAAAG AACTGCCTGT AATGGAATGA AAAGAAGCCA GGGCTTTGCT
GTCTTGGGAA AGAGGGAAAC CAGTGTAAGG GAAATGTGC TACCTTCTGG AGAGAGGACA
GCCCTCGGCT CCATGACAGC TGTCCCAGGT TGCCTTAGCA AAGCCTTCCT CAAGCAGATA
TTCACTGAGG CCCCTTCGGC AACTTTCCAA CATGGTTTTA CTTAAATACA CACACACACA
TGCATTTACT TCGTGTGTGT GTGTGTGTGT GTGTGTGTGT GTGTGTGTGT GTGT
```

Fig. 5-18

```
106296  cggct tgctccagcc atgtttgctc
106321  gtttcccgtg gatgtgcggt tcttccgtgg tttctctcca tctaaggagc tttgggggaa
106381  cattttagt tcccctacca ccaagcctta tggcttattt aagaaaacat atcaaaattc
106441  cacgagattt ttgacgtttt gatatgttct ggtaagattt ttttttgac atgtcctcca
106501  tacttttga tatttgtaat attttcagtc aattttcat ttttaaggaa tatttctttg
106561  ttgtgccttt tggttgatac ttgtgtgtgt atggtggact tacctttctt tcattgttta
106621  tatattcttg cccatcgggg ccacggatac ctgtgtgtcc tccccgccat tccatgccca
106681  acggggtttt ggatacttac ctgccttttc attcttttt tttcttatta ttttttttc
106741  taaacttgcc catctgggct gtggatacct gcttttattc ttttttctt ctccttagcc
106801  catcggggcc atggatacct gcttttgta aaaaaaaaa aaaaaaaaa aaaacctttc
106861  tcggtccatc gggacctcgg atacctgcgt ttagtctttt tttcccatgc caacggggc
106921  ctcggatacc tgctgttatt attttttttt cttttctttt tgcccatcgg ggctgtggat
106981  acctgcttta aattttttt ttcacggccc aacggggcgc ttggtggatg gaaatatggt
107041  tttgtgagtt attgcactac ctggaatatc tatgcctctt atttgcgtgt actgttgctg
107101  ctgatcgttt ggtgctgtgt gagtgaacct atggcttaga aaaacgactt tgctcttaaa
107161  ctgagtgggt gttcagggcg tggagagccc gcgtccgcca ttatggcttc tgcgtgatac
107221  ggctattctc gagccagtta cgccaagaat taggacaccg aggagcacag cggactggat
107281  aaaagcaacc aattgcgctg cgctagctaa aggctttctt tatatgtgcg gggttgcggg
107341  attcgccttg atttgtggta gcatttgcgg ggttgtgcta gccggaagta gaaagccaag
107401  gagtgctcgt attagtgtgc ggtgttgcgc ggaagccgca gaggactagg ggatagggct
107461  cagcgtgggt gtggggattg ggcagggtgt gtgtgcatat ggacccctgg cgcggtcccc
107521  cgtggcttta agggctgctc agaagtctat aaaatggcgg ctcggggct ccacccgagg
107581  ctcgacagcc caatctttgt tctggtgtgt agcaatggat tataggacat ttaggtcgta
107641  caggaaaaga tggcggctca agttcttggt gcggtataac gcaaagggct ttgtgtgtca
107701  catgtcagct tcatgtctga gttagcctgg agaggtggca catgctcttg aatgtgtcta
107761  agatggcgga agtcatgtga cctgccctct agtggtttct ttcagtgatt ttttttttgg
107821  cgggctttag ctacttggcg ggctttgccc gagggtacac ttggtgcatt atggtagggt
107881  gtggttggtc ctaccttgtg ccactcgaag ctgaggcaag gctaagtgga agtgttggtt
107941  gccacttgac gtaactcgtc agaaatgggc acaagtgtga agtgttggt gtttgcttga
108001  cttccagtta gaaatgtgca ttattgcttg gtggccagga tggaattaga ctgtgatgag
108061  tcactgtccc ataaggacgt gagtttcgct tggtacttca cgtgtgtctt tagtcatcat
108121  tttttcgaag tgcctgccca ggtcgggaga gcgcatgctt gcaattctaa cactgaagtg
108181  ttggatgatg tcggatccga ttcgagagac cgaggctgcg ggttcttggt cgatgtaaat
108241  cattgaaacc tcacctatta aaagaaagaa agtatctaa ggccatttca aggacatttg
108301  actcatccgc ttgcgttcat agtctcttac agtgctctat acgtggcggt gcaaactaaa
108361  actcagcccg ttccattcct ttgtattgtt cagtggctag tctacttaca ccttggcctc
108421  tgatttagcc agcactgatc tcaagcggtt ctctaagcct actgggtata agtggtgact
108481  ttggccagag tcatagtgga tcacaaatca ctggtgaaga ggtagaatcc taccttcttc
108541  caaaatctac cccatgacta ttgctggggt tgcattttga tttcaatgaa tattttggat
```

Fig. 6-1

```
108601  gccaacgaca cgtctgatag tgtgctttgc tagtgtttga atttaaaacc gaagtgattg
108661  ttttcaaaat gtatttacgg atttgcttac ttgttgaatt catttttaatt acctttagtg
108721  aattgttact ttggagtcct taaagttttc aataattttt ttggcagatg atactcaaat
108781  tacttggcac ttaaatgtac tttctttcaa actcatccac cgagctactc ttcaaatttt
108841  taagtcttat aacacagata ctgttaatgt aaagtgaaca ttatgactgg atgtcaggag
108901  tatttgaggt tctataccag ttcaggcttt gcttttgttg ctattgttga tgctatattg
108961  actaatggtt ttacttgtca gcaagagcct tgaattgtaa tgctctgtgt cctctatcag
109021  acttactgtt ataatagtaa tattaaggcc tacatttcaa ctttctgtgt gttcttgcct
109081  ttatggcatc tagattctcc tcaagactca gcaaatagtg ctgctgctat tgctgcccca
109141  gccccaggcc cagccccagc ccctgcccca gcccagccc cagcccctgc ccagcccca
109201  gccctgccc ctgcccagc ccctgcccca gccccagccc cagcccctac ccctgccct
109261  gccctgccc cacccaacca acccaatcca gtccagccct gccccagccc agtcctagcc
109321  ccaggcccag atactttcag acctatccca agcccacttc tacttagaga aattcgaatc
109381  ttcattgatt cagtgctaaa atgcagtgtc catcactcag cctataagac tgagacagcc
109441  catctatacc ccctccatac tgacttctag agtcatggaa tttcacttaa tgcatagaat
109501  cgtattgcta aaatgcagtg cccatcactc agcctataag actgagatag cccatctata
109561  cccctccat actgacttac agagtcatgg agtttcactt aatgcatgca gtcctattgc
109621  taaaatgcag tgcccataac tcagcctata agactgagat agcccattta taccccatac
109681  cccctccata ctgacttcta gggtcatgga atttcactta atacatagaa tcgtattgct
109741  aaaatgcagt gtccatcact cagtctataa gactgagata tccctatgta taccccatac
109801  tccctccata ctgacttcca gagtcataga atttcacttt gcatacggtc ctattgctaa
109861  aatgcagtgt ccatcactca gtctataaga ctgagatatc cctatgtata ccccatactc
109921  cctccatact gacttccaga gtcatagaat ttcactttgc atacggtcct attgctaaaa
109981  tgcagtgccc atcactcagc ctataagact gagatagccc atctataccc cctccatact
110041  gacttccaga gtcatggaat tcacttaat gcatgcagtc ctattgctaa aatgcagtgc
110101  ccatcactca gcctataaga ctgagatagc catctatac cccatacccc ctccatactg
110161  acttccagag tcatggaatt tcacttaatg catgcagtcc tattgctaaa atgcagtgcc
110221  catcactcag cctataagac tgagatagcc catctatacc cactccatac tgacttccag
110281  agtcatggaa tttcacttaa tgcatgcagt cctattgcta aaatgcagtg cccatcactc
110341  agcctataag actgagatag cccatctata cccactccat actgacttcc agagtcatgg
110401  agtttcactt aatgcatgca gtcctattgc taaaatgcag tgcccataac tcagcctata
110461  agactgagat agcccattta taccccatac cccctccata ctgacttcta gggtcatgga
110521  atttcactta atgcatagaa tcgtattgct aaaatgcagt gtccattact cagcctataa
110581  gactgagata tccctatgta taccccatac cccctccata ctgacttcca gagacataga
110641  atttcacttt gcatacggtc ctattgctaa aatgcagtgc ccatcactca gcctataaga
110701  ctgagatatc cctatctata ccctctaccc cctccatact gacttccaga gtcatggaat
110761  ttcacataat gtatagattt ctattgctaa aatgcagtgc ccataactca gcctataaga
110821  ctgagatagc ccatctatac cccctccata ctgagttcca gagtcatgga atttcactta
110881  atgcatagaa tcgtattgct aaaatgcagt gcccatcact cagcctataa gactgagccc
```

Fig. 6-2

```
110941  atctataccc cataccccct ccatactgac ttccagagtc atggaatttc actttgcata
111001  cagtcctact ttacttgtcc atggacaagt aaacaaagaa ctcttgtcct tcatgttaat
111061  caagatacac caatcaaaca agagttttat atcagagact tgccatggag gtatcatctc
111121  tcaagtctcc tttcctttaa ggaaagaaaa ccattctgtc attgctgtag tagtcacagt
111181  cccaagtttc taagcagtgt tcagtcgtct tttctcatgt attaccttga gtactgaata
111241  attctgtcag aaatattttg tccattggat tagactttag ctagtccagc cctgtgtgca
111301  tttagcaaag gggcaaacac aggtctgtta tcagacagtt aaagtgctca gtcccaattt
111361  tcaaggcatt ggccattaaa gggggtagaa tactatatac tgttggcatg ctgtcatggg
111421  tgctatcgcc ccaggtcaca tctttctaac tgatggagat acatttattt gctcatgata
111481  ttgtatacta gtctcacatg ctttcttatt tcagccaaaa acctctgcac tggaacattt
111541  tatgtggata atcctgacta ggaattgagt cttttctcaa ggtcctaata ctacccttgc
111601  tttatgtaaa gagggtgctg attacttaat gcctcttaca caattgtgca aaattgcagt
111661  tgttcaagtc cccttctgtt agtaaccaag atcccatacc ctcataccct aatgggtgac
111721  aatcaagggt gccaaccaat gagaccactt ctctgttctg gtctttctgc tgtgctgggg
111781  aatcaaacct tgagtcttgt gtacgctagt aaagcactgt catagagcta cagccccacc
111841  gtgtggtggt ttgagagaac agcctcttat gtagcctggg ctgggcggga cttacaggca
111901  ttgccacctg taatgtaaac atatttgtgc ctgttgtgtg cacagctgca tttgtccctc
111961  ttcctaagca ttggataaag aaaccaaact aagtcaagtc attttgttgg taatcaagaa
112021  gacctttgat ctgtcctgtt tttaacttcc aggctggcct ggaacttagc atataaccca
112081  ggctagcctt gagctcagga tctagcctgc gtttaacaag tgttggcata tctggttcct
112141  accactatgc cctgcatgca gtctttcata ttgtgaatgt gcatatgtca tttcactgta
112201  gtaatctgca tctggtgaag acttatttgt attgcagcag tatttaagat ccttaacata
112261  gtaaatgtgc acagtgttaa ctctattgta catattctca tgtccacagt tgtgccttt
112321  agatcaggac tcctgtactt agcaaagcaa agaggctcac taatataaag cttctttcat
112381  gagactatag attgaaacga ttccaatacg gtcaatggtc cttcaaggta agacttctgt
112441  ctctgatcat tcatatcctc tttgctttat ggaattatgt atgtgctgtg cacttgaaac
112501  cccttcctca aactatttat gtacatactg gcaattttag taggatcaat tttactctta
112561  actttgaagt acagaagtgg tgttgaccta taaggtccca ttttgtggct tgctaataat
112621  aatgactgat tgtagtaggc ttttctgtt cactacagaa ggaaacctga acagcgtaaa
112681  actgtaatgg ccataaacat gtaccttgca tattagtatg catttactgc acacatctca
112741  ttccatttgg atacgatcct actctcaaac ccttttgcag tacagcaagg gtcactaatc
112801  ttttggcttc ttcatcttcc tggacactgg ataaggctgt cccctccttt ccactcttta
112861  atttccagga ctattacttt aaagacttaa tatttgcata aaggatgggg ttttaattg
112921  ataacatgtc ccttgaacat taatgtatat aacagggaca tgatccattc attttaataa
112981  aaatacttgg ccagttaatg tgtaaaatta cacttatcca caaccttatt acttttcgga
113041  ccattgtatc tcttgcactc ctgcaaggga taccgtttat ctcccaaggt ccctgctagt
113101  ggaccattaa tatacagtga atcttccttt gtctttgcca gtaaacaaag gccatactcc
113161  ttcgcctttc atttgcacta tatcaggata tgctgatcaa caaggccgca ttcttttgga
113221  ctgttatcat atattaaatg tatgcgtatg cactgccacc tgctctgtgc acttgaaagg
```

Fig. 6-3

```
113281  atcccactca cttccttagc accttcagca ggaagtgata ataagctcaa gactttcatt
113341  tggaaagttc acatgtctaa gcacttctct aagaactact gtaccctctt ctccgcttta
113401  aagcagaaag agggttgtac gaagtgctct tcatttggac ttaagtgcat taatgcagtt
113461  agttgtccat cattaccttt ggagttggat tttacatcct tgtactcttt tgacaccaga
113521  ggcatattaa ttatttctga gcacttctct tgtcaatatt aatctgtacc cttacacata
113581  tgacctgtgc ggcagcaaag gttctgaaat gcctaccttt tgactggggc tgctgagtgg
113641  tagtaactat tagtaacctc agcatttgga tgattactat gcaaaaatgt caaggacctg
113701  tgtgctctct ttgcatacca tcaaggctac tgagtcccag aattaattgc taagttatgc
113761  gtatttataa ctatgaatgt ctggaatatt ttgtcccctt tacattattg cagaggttgc
113821  tgagcccccg aaactacccg gtactgtcaa tgagcacagg ggctctgacg aatgacctgc
113881  tctcttcctt aaactgattt tgggactctt aataggcaca atggcagttc tggatggttt
113941  attttctact ccaacttgag caaatccccct gctagtttcc caatgatata ataaagtaca
114001  gcagtatgta cacccaacaa tgacccggat ttcgacccctt tttgcattgc tttaatatat
114061  acaatcctaa atagtcacaa tctcacactt tatagtgttc cttttgcccg gcctctagtt
114121  tgtccattga ccactttcct gaatcactaa ttctcacaaa cccatcatta aggaagagtt
114181  tgtgcccttt ctcaattcca tcatgccatc ccttttgcct ctttgtttga acagtattga
114241  ctgggcaaag cccttctctt gacttaaagt caacaacacc agttactca cttcatatgg
114301  ctacagtgtc tcagttgcct tctccttgct cccactgaac agagacacct cgaattctta
114361  cattattctg ggtaatgtta attaccccaa acaccctatg tgtcattaat aaattttggt
114421  gtatttatac actgaatagc aaaagcaggc caaaactagg tggatgagcc ttcaatcttt
114481  aacttgcact tctaaattat tccaattcca actgctggca cattctaggg ccaggaacca
114541  ttcttgccta cctttattaa tgcttattg tgcaaaatat tgcaggcaag tagctcaggg
114601  agttggattg ccaccttttta cttggggctt tcctttacag tatgaactga aaattgtctt
114661  cctgagaagg aagcttagca cttttctttc cattcttcct ccaggaagga gccaactgtc
114721  tgcttaagaa actttaagcc cgattttgta tattgctact gtacaggacc aactgccaga
114781  aaagttattg ataatttat tccttaagaa aggcatttgg attgcaaggt ggattgactg
114841  tgagatcatt agcttttgtg aagtaaaaat agccatttgt gtcatgtttc tgaagactaa
114901  gcagtgtctc agtgtactga gggtgatgag tctgtggaaa gatcagtgca actattgcag
114961  aatgtttaag acaagtatct ttgcttggtc tttactacaa gtttaacaaa acgaaaaagt
115021  caatctttgt gtggccttta gtatgattaa cttttggaa gatgacctaa gccttctaat
115081  cattatattt tgtctgacat tggtcaccag tccttgctta tttttaaaag gtgactggat
115141  ggattaaatt tgagaacatg tcaagtcgcc tttgaaaatt atataggcca tcacatttaa
115201  ttaattcatt ctatccacca ttaaactctg gcaataattt gaagtagctt gaaaattcct
115261  aaagtgggaa tttattttag agatgataga acctgttttcc ccactttaca ttttaaaata
115321  tgtctgccag gatctaatca ttcctttaaa cgtacacttc aaagagagat tttcctagta
115381  agaaaagagc tttctctagt gtgaagggtg ctttgtagcc gccgagtact taggtctttt
115441  ttgggagcta ttgtgtatga gtgtatgtat gtgtgtgtgt acatgcatgt tgctgcgcgc
115501  agtcattcat tcacatggtg ctcagacaac aatgggagct ggttcgtcta tcttgtgggt
115561  cctggagatc aaagtgagat catcaggctt ggcagcaagt gcctttaccc tccgcgtgcc
```

Fig. 6-4

```
115621  atcttgccat cccgctgctg agtgtttgat atgacattgc tgatgaaaat aatcatcaca
115681  acagcagttc tcccagcatt actgagaaat gatactattt ttctgaggag gatgttcaag
115741  taactcatcc agtgcaggat cctgcttgaa ctactgctcc tccgttacat cagactctgg
115801  ctgtttagac tacagtaagt actaccttgt tagctactaa gctatctttt tctcattcga
115861  gtttctttct gtgccaccca ctgaaaagtc aaagtgacta ataagtcact agctcttctc
115921  agcttatcca tacacaacac atagtatgcc aacgaaattg tagaattaac acattgtgta
115981  cccaatcgcc attatgctgg ggtacactaa aatgagaagc gatgatattt tacaaaattt
116041  cttccgtgag atgattatgt tatttaagac ttaatgtaat ataagcacac ttgagatcat
116101  tttaggaaat gtactgcctg tgtgaattgt ttaagtattt taggaagtct actggggttg
116161  aaatttgact tcttaaagag ggaagtgtgc ttactttgcc ttgttggtcc agacgactat
116221  tagtaccatc tggttggttt atctgaatgc catctgtttc tatctacctc ttggaagcat
116281  ggaaagaata ttaagagtga aagactccat gcattatgct tagctgtacg ccaagggtag
116341  caagagatga gcttgtgtag gaattgggaa tataaatttg ataatttggt tctttcaacc
116401  atttttactg catttctgcc cagaacagac cactggacgg cactaacagc ttagacagag
116461  aacttcatag cttacaatct tttttttttt tttttttttt tttttttttt ttacaaaagt
116521  gcaaagaagg ataagttta tgaacaaatt ttactatgga ctactttatg taccctcctt
116581  gctcatttt cttttcatt aattaatcaa ttaattttgt tttgttctct gttttgtttt
116641  gtgacaggga ttctctgtgt agtctggcta tcctggaact caaactcaag agatccgccc
116701  gcagagatcc gcccgcctct gcctccagtt tagagtgttg ggattaaggg tgggtgccac
116761  actggacccc tgccagcact tttcaacaga tactttcagt taaaacaaca aatacttgac
116821  tcctgtgtag aaaatggtct agctgaaaaa acatccttgt ccataacact taacattttt
116881  ttgcatttgc cttttgtacg tgcaaatgac cctctagtac tttaacccctt ttaagtccac
116941  tgtaaattcc ttcgcagcag gtttccccca actccaaagg cttagcattg tctggctctc
117001  taggtgataa tacatctaga actattgagt cttttaggaa actaggacca ttgttgtaca
117061  agtaactgct tcaaaggaa acatttgcaa ggaaaaaaag cttttgaga tgctaaagaa
117121  tgtgtttggt gcactaagac agttagctaa agcttcggtc tcaccttagc accattggct
117181  acccacccca gtacatgcaa agtgaccccc ccccaggct tgcctaggca cctagagctt
117241  tcagcctgcc tcctatggac ctaaatagag attaggactc agactccagt tagtggcctg
117301  gaggaagctg gtactgctgc tattcacagt aaacccacta tcactgacag ttccctattg
117361  aaatgatcaa gttgtgtgag caggcagatc attaatcagg gccaattctg tcatggcaac
117421  ctagtcctac atgacctcca cggcactgta aaatacacac ttatttgtag taggacatct
117481  ggaacatgag cttgtctgtg attgaaatgt ccattaggag gtgccatcac acaaaaccat
117541  ctggaggcca tctttggtcc ccataattga tggaatacaa agagttcccc aaattagtgt
117601  cctgacccag ccctcactgt cagtaatcat gtaatggaaa gccaccaact cgccatcacc
117661  atcttcaggc tgcctgaact gtatacatta agaatgagct ttcagccggg cagtggtagc
117721  tcgagccttt aatcccagca cttgggaggc agaggcaggc ggatctctga gttcgaggcc
117781  agcctggtct acagagtgag ttccaggaca gccagggcta cacagagaaa ccctgtcttg
117841  aaaaaaaaag aagaatgagc tttcttccaa gctgtccaat ggcttgaccc agacttagga
117901  gtttgtaaac aaagaaccct gtagaacaag tgaatttgag aatgtacacc ttcattaagt
```

Fig. 6-5

```
117961  ggtgggaagt ggaagtagtg gattttgcca gctgatttta caaagccctg tggcagaacc
118021  agaccaggtc tttgtatgca tactgccata taacctagcc actgtccaac ctgtgccctc
118081  tctcccagtc cagtgaacct cttctgcctg ccccttactt agtcctctgg ctcatcccag
118141  gggaagatgg ctctatttgt gtagtcataa gaaagttttg ttaattttaa ataaaacagg
118201  aaaagagaaa gctcacttaa gacgagagct ggagagatgg ttctgttagt cttccagagg
118261  tcctgagtac aattcccagc aaccacatgg tggctcacaa ccatctgtaa tgacgtctga
118321  ctccctcttc tggcacacag gcatacatgc agatagagta ctcaaatata caaaaaggga
118381  aaagaaatga aaggcctttg aaatgtagac atgctttcaa ttttaaaggc tgttttcaca
118441  tctcttaaga actaggggtt ccatgagaac atatcctcac cctgagttct taccaccaat
118501  tgaaaacgct gacatgtgca tatgaagatt gtattgctag taatcaaatt atcatttgta
118561  gagtttagta taattatcat ttgttttcca gggatgaatt tggagtctgt tttgtgctcc
118621  tgcctcaaga agaaggattg cctggattta gaggagtgaa gagtgctgga gagagcccaa
118681  aggtatttcc gttacttggt tgactgagat agtatcttcc cttaaaggtc taatgtgtca
118741  agttatacct cctaagtaaa tacctcatta ttttcatgtg gaattttcaa caattttgt
118801  agtctaatga tagccttgta tttcttcaca gggacaaaca atccctatgt gagactcaag
118861  gactgccagc agcctataca gctacattac atctcagcag aacttctctt caagtcctcg
118921  ctactctgaa caaaaagctt acaggccaca tggagaaaaa aaggtacttt ggagaatttg
118981  ctatttgggg gtttctatct gatctccagt tcatcagaga atgaggggc aagtcaataa
119041  agcactcccc atctcctggt cccctggcat agtcagttag ccaatgagat ccttgcctta
119101  tgatgaggcc ttgaaatcat ccccaccatg ttatgaccaa tctgtaacat ttctgctctg
119161  aaatgcctaa aggtaggtt atcagaggaa tgaaggccag tttctgacac cctagtcttt
119221  tgtacttgat agagtaagta gatatggctg ttgtcacatt ctgtaggcct gtcataattc
119281  tggtctctga atatcctcaa actcagaggt ccaatgctac accagtttct agggacatat
119341  gcaccataag cactgagcca aacaatgcta ttcaccttgc cagtgttctg gcatggtatt
119401  gtttaaagca caaattaaaa gaagaaaata atttaacccc tttattccca gagtatttga
119461  agtacaagga ctttaacaca acctataatc taaaggatct ctcattggta ggtgacagaa
119521  taaaagccag aaagaacttg gatggagcaa ttctcatgtc tctaagttaa cactaagatc
119581  tacaaatgtg aagggttcac tctccaagcc cctccccatg atttaacaca actgctggtt
119641  actacataat gagacaactt cccagtatt cttgatttca agaattggct tttcttcac
119701  ctcttttcca gatctccccc cagaattgtg ggcttgctgc tttgcagtgc tggcgaccta
119761  ttcccttga cgatcccag gtggagatgg ggcatgagga tcctccaggg gaatagctca
119821  ccaccactgg gcaacaggcc tagcccagat tcagtgaga cgctttcctg aacccagcaa
119881  ggaagacaaa ggctcaaaga atgccaccct acatcaaagt aggtaagttt tctgcaacag
119941  tgtaataatt ttaactttga tcttgttttc cattaaagtc agccttttac ttgagatata
120001  tacataaatt ttatcttttt cccacatctg ggaaatgtaa ctaaacagtg caaatgtttc
120061  ttctaggaga aaagctgctg caatagtggc actgaccttc gaggaagcca ttctgctcta
120121  tttggttctc tctccagaag ctaggaaagc tttgccagct gtttacatac ttcaagatgc
120181  actgctaccc tactcatgcc atataataca caagtgagta gcttatttac ctacctagct
120241  atttacgagt acactgttgc tgtcctcaga cacaccagaa gagagcacca gatctcatta
```

Fig. 6-6

```
120301  cagatggttg tgcgccacca tgtggttgct ggggattgaa ctcaggacct ctggaagagc
120361  aataggtgct cttaaccact gagccatcac taacattact gatgatgaat gcctctaact
120421  acaaatggaa acctggctgg aattgataca gaagtatcta tcattaggca gaatttaaag
120481  agccaggatg ttctagtact tctttcctgg cattcataca gcttcttttg ttctttgtag
120541  tgccatctac caaatattac ccttccccaa agcagcacag aaaactgggt cttcagcgtg
120601  atcaagcaat gtgaacacac aaaaggaagg cagctttata aatgacccga ggatcaacat
120661  gcctgactgc agcatcttaa aagcaataga atgaggtaag tcactagcat tgcagtcttc
120721  tgaggatttg catttgctgg aagatggtgc tgggtggaga gcatctaatg tgataatgtg
120781  aggcagggcc atgtacacga tggaagatga acaggctttc acgttatcaa atggcctcac
120841  agcagcaact caaactatta tctgcttacc agttatatca caagaggaat ttagcttcta
120901  ggttttgttg ttgttgttgt ttgttttggc ttggtgccct accattctta cagacttaaa
120961  cattgaaaag ctttaaatag tttatttctt atctccatct gtgaagcagc cattagactt
121021  gtgaaggatg taaaaaccaa gccccccctt tttttaata gaagaggaga gtgaagctga
121081  caattaaata tgcagtcgct tatagtgttt gctgcttaca gaagctttta atccatgtaa
121141  cagaatgttg agatgttcat tctgtgttta aatgtaatat tccctagatg tatgcccttt
121201  ggcaatttag ttctgctaag acctgtctgt ttgtgaaggt caaatgaaat catgaatgga
121261  aagtgttgag tacagagcct ggcaaatatg ccctggagtt gcatgactag gccatttgga
121321  agagttgacg ggtgtgtcct atggtcctat gttaaggaaa ccttaagttt aacgttgata
121381  gcctggtaca gtgtactaat ggcaattttt ttctttgccc ttccctgttt cttgttaccc
121441  tctttctggt ggtctttgct tactatcaat cattagtgtg tattgtgggt gtgtctattt
121501  cttgttttat gtatctattt tttccttggt ctgtgtgtct aattctttgt tacatctatt
121561  tcttccttgc tttgtgtgtc tatttcttcc ttgctttgtg tgtctatttc ttccttgcat
121621  tatgtctaat tctttgttat atctatttct tccttgcttt gtgtctattt cttccttgca
121681  gttgtgtcta attctttgtt acatctattt cttccttgct ttgtgtgtct atttcttcct
121741  tgcattgtgt ctaattcttt gttatatcta tttcttcctt gctttgtgtg tctgtcttcc
121801  ttgctttgtg tctatttctt ccttgcagtt gtgtctaatt ctttgttaca tctatttctt
121861  ccttgctttt gtgtgtcttt cttcttgct tttgtgtgtc tatttcttcc ttgcagttgt
121921  gtctaattct tgttacatc tatttcttcc ttgcttttgt gtgtctattt cttccttgca
121981  ttgtgtctaa ttctttggta tatatatttc ttcattgctt tgtgtgtcta tgtctccttg
122041  tgttgtctaa ttcgttgttg catctatttc ttccttgctt tgtgtgtcta tttcttcctt
122101  gctttgtgtg tctatgtctt ccttgctttg tgtgtctatg tcttccttgt tttgtgtatc
122161  tacttcttcc ttgtgtgtct aattctttgt tacatctatt tcttccttcc tttgcatgtc
122221  tccttctttc ctttgtgtgt cttttctgtc tgcagtgtgt cttacctatt cccatgtttc
122281  tcctgcatgt tctttcttgc agagctttga gctttgtttc acttctctg gtgcctgtgt
122341  ggtctgcttt gtcttcacta gctatggctc tctgtttttat ctatctggtt gctatttctc
122401  ttagcttttc tttcactcct gcctttcgtg actccccttt gggtcacatg ttgcatgcat
122461  ccctctcttt ttcttgtgct caccccactt gttctttgtt caagttctct ttgtcagtcc
122521  atttcagttt tctttctgct gcttctatcc ttagtgaatt cttgtttaca ttcttccct
122581  gcctttcttg ggccactttc tctgttttct tttgtatttg tgtctctttg ctattggtgg
```

Fig. 6-7

```
122641  atttcttatc tcagcatcat tctgttgctt tgtgtttgct tgtgtttcta tcttctactt
122701  tcctcctttc tgttcacttt gagcatttca tctctttaca agtctgtgtc tctcttgtat
122761  tctaaagtaa tcctttcttg gatgtttctt tgtatgtaca tgtgcgtgtg tgcatgtgtg
122821  ttatgtgtgt catgtgtgag aggagcttca tagccccttc ccaataggtc cagaatgtca
122881  cccgtggagc cgttcctcac accagactgc cctgagaaat aatctaagac aaaatacatc
122941  attccgtccg gtcaggattc aagtggctct gaagtgaacg cccaagtaga agacagaagt
123001  tttgcgactt gagatttaaa aggaccaaaa tacacagatg gcccgtcttg agctggctgg
123061  acagaatgct gacaacccaa agaagaggaa ctgtttctac aggacacctg tgacttccaa
123121  gagcggggaa ctacgtatgt cataagacac aaaacctgag ctaagtccaa gcataagacc
123181  taaggaccca atcctatatg gacagaatat ttaagagata aaggcctatg gcccagaact
123241  ctggaaggat atttctatcc ttctatcccc aagaccaaga agggaaattc gaagatgaga
123301  cctgccccc aaccccagca tccctttcca tttcttatat ttctatttaa gctgtcttca
123361  cttgagatgt aattttttcat tgttgccatt gcccataaag gaatacgttt ttagctggat
1234211 agtattgtgc aagggtctgt tttaaactgg gtcttagcca tttgttaaat tgttgatgtt
123481  ttacaacttc catttctctt cacatctgct ccacttgaga cggaactaaa tccagccagt
123541  gtatatagcc tgactattga aacttcccta ggaataagca tgcatacaga tatgcatact
123601  gccatcctcc ctacctcaga agccctaggc tgacaagaaa aggaaagcat caggttgtta
123661  gggggaaaac aatgtcaggc tatctagaga aaatataaag agttgttcca gaccaatgag
123721  aagaattaga caagcaatat gcagatgtgc caaccctctg agaagcacca gccagtgtca
123781  ccttctttct ttgggcttag gtgagcaggg tatggttttc taataatggt ttggggacaa
123841  aatgaggtct gaactccctg ctcatagtag tggccgagta atttggtgca tttcaccaaa
123901  ggaactcctg ggtctaatac ctacctttaa aattaatgat gagagactct aaggactact
123961  taacgggctt aatcttttc gtgccttcct cttcctctgt aagagggaag ttaaatgaca
124021  caggatgaaa aagtaacatg ctcatagcac attggcaatt atacatggtt attatctgaa
124081  agtgtagagc ttttcctata aggcatcaga ctaagtacct gaagctttgt gggttcatgg
124141  tcttagttgc atattcctta gttgcaaatc cttttcaaaa ggtaagaaaa aggcacactg
124201  gtctattgcc tgtacttgat caagccctga tatgaatgcc agggaatgtc tgagtaacat
124261  taatttcctt ccctgcatat tttttgtgct gaatactaag gctgtgatgc ttcactgtgg
124321  tcaccccag gtaacaagat attaccaggt aaccaggaaa cgtatgaata cgtaaaccat
124381  gaagcctact gtaacttcca agtcagtgct gagtatgtat tacatagtag ctgaagtcta
124441  cgcctctgtg tgctataggc acaaagattg ctctaggaat aacatgcttt gtaaaaacaa
124501  atatatgaac ataacggggc ttgaatgaat aacagtccat atacttaagg ccagtgtgtt
124561  tcttctgctt tggtgaggct cagtaagtta tattatacca ggtagcagaa gagaaaacac
124621  atggaaactg atttttaaact acaaactagg tcactaatgc aggtgattga ttaccctatt
124681  ctgatcacct tctaatttct gaatacccat gttcagcact gggaataaca aaggggggaca
124741  ttaccacaga actagaattt acaaaagaat gcattaaata aagcattata cagctatcaa
124801  ttgttccatg tgtgcaaatg aatgactact aactacctct gatgtatccg atattgtttt
124861  gggtacatga aatattcatg agtaactgcc atgaaataag aatgtttgca ttccatacta
124921  ttcataagga atgagccaat gcttaattta atcagtcaaa acttgagtga taagggcatg
```

Fig. 6-8

```
124981  ttaatacaag aacatttgcc caggtcacat tatggttgtg ggtactttct taactataaa
125041  gcagttcagt agtataagac aagacaaatt ttctatagaa ataaagctgc ctataaaata
125101  ggcatagtct ctacaaaatt ttcattgtac ttttttagccc ataatgggaa gagtacagtt
125161  aacaagctgg gtgtggtagc atgtgctctg agctgaagca acaggaccac ttgagcccag
125221  aaattggagg ctagcctggg aagaccataa ggtcaatctc aaacctggag ctaaatatt
125281  gtctcccatg tgtatattct ctttcatggg tactggagag atacacagac gtacatttca
125341  gtgtgtccac acttgagaat aatatgtacg ttggcatttt atgaactcgg aggtaccata
125401  taaatgtaac aattcatttt cttacttggt atcaatttcc aggcttttaa aattctgcca
125461  catttattat actgtgaaaa taaagtaaat aagtaactgt gaaccactga atatatgaag
125521  cattcaatac ttgatgagta catactgaat ggcagtcatt tattacaaaa cagtgcccct
125581  gctaggcact gggatgcaaa gagcattctc attgtcctgt gtatctaaag aaattatgca
125641  tgagattaat ttataatttg taaactgcca tatatatgtg tatatatgca atatttgcct
125701  ggtgtgcaat gactttgctt ttatcccagg catgcacaac agatctgtgt ggagctttgt
125761  gaagtctaca gttctataaa gccgggacct aactgttggc tttatcagtg aacagtgatt
125821  actttctaag tttcataatg gctgaaactt aatcataatg cttatcacct aacaccacct
125881  aataataatt ttaccatgct atgtgttgag cgaacacata gattgctttc tagcattatg
125941  tagcacttat aggagtgaaa tctagaccaa aacttcaatt cacttcaatg aggaaatgaa
126001  aacagaaaaa aaaaatggat ttgtgcaagg cagtgtgcta aatgttacac tgagtggact
126061  atgctgtcta ggatacttcc cagctggctt gactgaggag gtggaaaagg ttttattaat
126121  gacaggaact ttttccatcc agtttcttaa atgtttgttg aatgctgctg ccagagatga
126181  attacaaaca ccttgccagt aaaggagttt tataggggcca gagtgagata tcccagagc
126241  atgggtatca gggaacaaaa cgggaagagg ccagagcatc tgatggcatg tactcagtgt
126301  ggcccagaac ctctcgaact agatgtactg gctggaggga ccaagcatgc agaacacaac
126361  acctaatgaa acattgtata taaaatatgc taacctaggt cctaaaacta aaatgtgagg
126421  tggacctagt gtagatcact gatcatagga gacatggtct cataaagccc aggctggttc
126481  taattggtga ctgtcacagc ttctcaagtg ctgagattac agatgtgctt aacccatgcc
126541  cagcctgaag aatatatctg attactgagt gaataatatt tttaaagaat tatatatttt
126601  atgtatatga gtacgctgtt gctgtcttca gacacaccag aagagggcac cacatcacat
126661  tacagatggt tgtgagcccc catgtggttg ttgggatttg aactcaggac cttcggaaga
126721  gcagtcagac tcttaaccac tgagtcatct ctccagcctt ctgagtaaat attttaacta
126781  taatggctgt ttgcgaaacc caaccaaggc caagattcct tcaacataaa ctggagactt
126841  cctagctaag gaagctccaa aagtcatttt ctcattggcc tagcttgaag ccaggacaga
126901  cttaaagtct gtcctttaat tcattaccca ttttccttt cttactgttg aagtgtttca
126961  aaggagaatc aagatgaatc gataattcta aacgtatttg ttcattgcct ggctcagcgt
127021  catgtgagca agaagaatat actatcacac tcatactttt aacttaagtg tgataaagt
127081  gcagttctaa gtactaaaat ttctaagtac tgaaaagaac aaagacattt aaaggatgca
127141  acccaaagtg tactttacct cagtagtttc tgagggact gcagtcacac cttgagacta
127201  cagctctcac tttagctggg aaaaacatca aggtgtagag gaggcaagtt aaataaaaag
127261  ttgctcccct cctcatgggc atgcttggta gagtggaaat aataaaagag gttctctatt
```

Fig. 6-9

```
127321  tcctcggttc cacacattgc agaagatgct actggatgct aagtgcaaca catttgttcc
127381  aaaagggcac tcagtgtgac ttacagatgc cccggaaagc agagggatgc tctttattaa
127441  acagaaatat tagctcaaac gttttctaga ctgaagaaca ctttcctcat ttcccacagt
127501  ttgcctcaga ggttgaatac aggaaggtta ttattcattc atttgcttta ttggttcgcc
127561  tgttctacaa ggatttgcat gtctcttagg ccttcacttg gctcctgaga catggaaaaa
127621  ggaaacatag acatagggaa gtgctggatg gggggggggg gtctcttttc tgggtagtgg
127681  cacgacttag tccttagtcc ccaagtaata tgcaatgtga gtcctcatcc tcatgtcttc
127741  tccggccact gcaatgagtg ggaagctggg ctttgtagca agcctgaccc taaagttaca
127801  gaagccctcc acgctaagaa actcaatttt ctaggccatt ttagctatga ctgtgaccac
127861  tactggtcag gagggatgac agccatctaa gttccacaat cttaggctac tttgcattat
127921  cctggggcaa acaagccatt tttgagctgc agcaggcttt gaaatacatt gaccaatttt
127981  gcctgtgttc gttaaacctt ttaccttttt acatgctaat gctcacagta atttagaaat
128041  gttctcctta ctataatata ctcaaggtgg cttgctatgg taaaataatg ccagtggatg
128101  aaaataacat taatgtttaa cattcttgca taaaatttaa gaataataaa attgacaaca
128161  atcagaaaac tggaggaacg aaagaccaaa ttgaaagaac ttgaaaaaga ttaaaaatgc
128221  ctgtgctttg ccccttttcca tttttctttc actcacagag ggtgggacag gaggccgagt
128281  gaaggaaagg gtccagcctg tctatctgga atctaagttg ggactttaat gcagttccac
128341  aaaattggta ttaattcgct aaatgttcct gaaatgtat tttcatctaa atggctatca
128401  gctaagcctt gagtcaaatg ggaatgaaac agattaagtc aatgtgatct ctttatccaa
128461  gttgccttag agctgaagtc acaatttgct gtaaggaagc ttattcattg tagcatacgc
128521  atactttcaa agtatctaga ctttacttag taacccaatc aggacattca ggcaaaagaa
128581  aaggaacaga gaagatggag ccaggttgaa gaggtctggg agttcaaaca aattttttc
128641  attttcatta aaactcaatt gggcatcaaa agtgttacta atattagctt ttaattagtg
128701  gaaattggct ggattcagta atatcccttt gtatgggtag gaatgggctt acatttctgg
128761  aatttgcaaa ggaaaaaata actgaaagcc ttcctttcac agttactgcc atcaatattg
128821  ctaccaatta agcacatcct accatcatct gctttgatca cataaatgaa ctgtgtacca
128881  atctgttgtt gaaagactgg agtcatcttc ccaccaactg tgaaaaaaca catggaaaac
128941  acctggactt tgtgaacgga tgcggaatac agaacttctg ttgactcttg ggtgttttga
129001  agacttgaaa aaaaaaactg ttgcttacca acatgtcaca atgagtccgt gtgtgggtgg
129061  gtggatgggt gggtgggtgg gtgggtgggt ggttgagtgg gtggggtagt ttgctgttaa
129121  ataaaatgct ttgttttgaa
```

Fig. 6-10

MOUSE XITE REGION

```
tgtctcaaaa caaaacaaaa caaaacgact aaccagtcaa caatagataa caacatcatg
ccctgtataa aatacctaca agttaatgtt aaaacacaag tcaatagagt aggggaaagg
cagtgtgcat gtggggagta ctcatatgtc caacaaaagt aaaaatttgc cagaatcagg
tgtttgtttg agggagggga atctcaggaa gcttgggata tcttgttcaa ctcatgctcc
tgcctccacc attcaagtgc tagcagtata agccttcttt tttatttatt tatttattta
tttatttatt tattttatt agatattttc tttatataca tttcaaatgc tatcccgaaa
gttccctata ccctccctcc gccctccacc cctacccacc cactcctgct tcttggccct
ggcattcccc tctactgggg catataaagt ttagtataag ccttcaataa caaacatgtt
cggccccaga atccccatat tcaaagctct gtaatgtagc aaaaagtcca caagatggcg
atagagacaa ggtgctaggt taagtagaag aggaagttca aggccctctt ttccgcaggg
aaagtttgtg aaattttcc tggtccttgc tctagctctg tctggtggaa tgtaacaacg
ttggaggaag cagtttcttt tttcgggaag gagaaagatc tagggatatc acgctcatta
ctttctacac ttatctgaac gctatctgga gtcagaaatc aaatagctga gcgcatttgg
atagcagtga tcaaaactct ggaaagagaa agtatactgc aggggaacag cgggctgcta
agtaggtgta ggtagtccct gctgaataaa ctaaagtagc caacgacttg aaaagaaata
gagagatctg cagagaattt aagaggttta aaaggcactg tgtacacatg tgctgatttt
ggaacttcct acaaagctgc acgaatcaaa agtacatgga ggggttggag agatggctca
gcagttcaaa gcactgactg ctcttctgaa ggtcctgagt tcaaatccca acaacaacat
ggtgactcac aaccacttgt aatgagatcg gatgccctct tctggtgtga tctgaagaca
gctacagtgt acttagatat aataaataaa taaatcttta aaaacagaag tacatggagg
tggatttgaa ggtcagcagc tcatattgct gatggagttt acttggagta gagtggaaaa
tgtggacata actgtgagtc tgtgttctga ttgttgcctc ccagaagatc aactcagggc
attaatgatt gatccactta catgaacttc ctcaggcaga catttaaaaa ttaattatag
tgttgttatc taggttatga caacatagtc aaagccagca aaagggatgc tttgaggtga
cgataggga agatagcttt gaaattttgt ttctacgcat tctgggggaa ctacaaagtc
atctatgtgc ccattactca agtcatattc aggagaaagg gggggtggaa aaggttgaag
tccttaatct gattgtaacc agcttctagg ttcacaaagg cagtaaggtg aaggacagga
caacattgaa aactgcctgc ttgccgggca gtggtggact taatcccag cacttgggag
gcagagacaa gtggatttct gagttcgagg ccagcctggt ctacagagtg agttccagga
cagtcagggc tatacagaga agtctcatct caaaaaaaa aaacaaaaca aaaaaaaca
aaacaaaaac aaacaaacaa acaaacaaac agaaaactgc cttctgggta ttaaaagtgt
gtttcaacga acatagagcc catctggaga gatagctttg tctcccttct ttttgaagtt
tcttttttat gtgttttggt aattaccagc atgtgtacca cctgcatggc tagtaatgtg
gaggccagat gcttgagtca gatccctgg ggctggagtt acagacagct gtgagctgcc
atgtgggtgc tggaaacaga acctaagtcc ttcataagat cagccagtgc tcttagccac
tgagccatct cttcagcccc tttgtatcac atctttaagg aaattctgtc aagtctagaa
aacagacccc catggccaca cacaacaaag aatgcggatt ttataaaaat ttacacctca
aattccaata tgcaaacaca cttcaagtaa atgagcaatg ggcgtgtgag aaatctttgg
tatgggacaa gcccacacag ggtgtccttg caaggacatt ctataggtct cagaactgag
ccttcgttat gctgctggaa gccatcttta tctagctccg ttgagtgaga gtttgcttgg
```

Fig. 7-1

```
gaacagacct ggtgataatt atgtaacagg cagaaactgg ctgaaggtgc tgtagcaagt
gacacaaata aacttgttca ttcttggagg aggggagcag tggggtcaaa actctgagaa
agaaaggaca atctatttcc caagtggcaa gattataaaa ttcaacctgt cacagtgaca
accaaaaatg acctggtaaa caaataggaa tttaagattt gtacataaga aaaatagagc
cttcctgctc ataatgtaga tgtgcagctt ggccttcatg tggatcctga actactggaa
cactggaacg ggggctatca caaaagctgt tgcctgtcca tgggatttgt tctcctagct
gagttgcctg gtgggcctca gtaggagagg atgcacatat cctcacagaa acttgatgtg
tcagggtggg aggataccca ggggccctca ccagctcaga gaagaatggg agggagaagg
aagaaggatc atgggagggg gggacctgga gttggggggca gtgagcagga tgtaaagtga
ataagcaaaa aaaaaaaaaa aaaattgtct cctggagcca ggcgtggtgg cgcacgcctt
taatcccagc acttgggagg cagaggcagg cagatttctg agttcgaggc cagcctggtc
tacagagtga gttccaggac agccagggct aaacagagaa accctgtctc gaaaaacaaa
aaaataaaac aaaacaaaat tgtctcctgg aaatccagaa gaccagacag aagatagtca
accaaagaaa agacttgagt gatactgtaa tctgactgta taacacagaa caatacaaag
gcataacagt aggaaagcaa gcttctcatt gtaggctcgg tcttcaggga agactgtatc
ctagggcaaa aaccaagtgt ttcctcggga tgtgctaaac ctggtgctgg cccagtatcc
tctgcaatga tagaattcta cctagactgc tccatttttc agccagcctc tattcagcta
gactccagaa aaacaagttc agtgtttggt gttttgctat tggtcacta ggtggcagta
taagcccagg tttgtgctac agacttaaag ccataaaaag gagcttggtt ggtcatattt
ttacaaatac aaatatttgt agtaccttgg atgactttag atggatgcag tcctctgcag
tgatctatac tatagtttat atgtaactcc aattaaaggc atttcaaatc agactggatt
agcatggata cattttggg ctgttagctc cgttctattt tgtttacata tgtttctttt
ttcactctta gggaaactca ttccaacagt cccacagctt cttgtcagag gtcctcgata
aatattaaaa ggttgaattg aaacacagca agttgtaaca catcacacac atgtatacat
atatacatgt atacagcaac catatgctag ctcatagcac atggtagccc gcaaccctct
ataatggcat ctgattctct ctttcattgt ccatgaagac agagaacaca tatagattga
gtaaataaac aagtaaataa atgatcttta tacacatacc tctagggaaa acaatatgaa
tatagctctc ataaattctc caaaaacaaa tttaaaaata aaaaagaac ttaaccacat
agaattatac tagaaataaa agcaaaaaga tagggaaa attcacaaat gcatcgaaat
acaatttgcc taaacatcca agaatgaaa gaagggaaat tataaaatat gaagatggat
aaaagcatct caaagtagca gcagaccaga agttgtagca tggagtaata gttgtaatag
gaaatttata cttgtaaata ctgacataaa agaaacatta aaaagacagt taaaaaaaat
gggtgctgta aatctgacca agaacccaca acttggacac tcaaagaccc ttggggtgat
agtggtggac catccattat tattttgctt atcagacaca tcgtctaact cctctctaaa
tacagacctc caacgggaga ggctggctca gtggttgaga gcactggctg cttgctcttc
cagagcacct gaatgcaatt cctagcaacc acatggtggc tcaaagcaca tggtggccca
caaccatcta caatgggatc taatttcctc tttcattgtc catgaagaca gagaacacat
atacattaag taaataaaga aacgaacaaa taaatgatct tttaaatgaa tacttctaga
cccatggatt agggtagctc tcagacctcc ccagagacac ttctttgtgt agtgaccagg
gctttgatgt ggtcaaaatg gagagaatag tatctgtaga gtgtgaaggg tgctcagttc
```

Fig. 7-2

```
taaatggagc atctatatca cacagttaca tgcaaacctc agagaaaatc acttaagaca
ggggccatct gggctggggg ttaagcagca gtgacaggac cggtgctcag gagctcacag
cagctgtgat tccaatacta ggggaggtac tcgatctacc gctgaggagc cattgggagt
taatggtgtg gccctctgat agatccatca acctgcaatg gatgacccca tctccatgca
tatatggttg gttggcacaa acgggaccca gtgtgttatt taaaaacaaa aacaccatta
aaaaaaccac cacaccaggc caaagccata ttttagcat cacaaaaaaa attgaataaa
atgaacaatt tcttcgactc tatcagggaa ataacattcc ccaaattaca aagtctctta
gagagagcag cgacttgctg atgagtgaga aaacagctcc tgtccacaga cagtgtgaac
acaggaaaac aaactgacgc tttcttggaa ggtttgtttg aataaattta ataataagat
aatccaggct atatccagcg agcaatacac ttttgtgact tttcttcata ggagccctag
agcatgtttt ttagtgaaaa tgatctccat agggattgga acagaaagag aaaaggaagc
attctgaaac accccatag cagtctgctc tcctagcttc agcctcagac aaacgtgact
cattagaaat tcaagtaact gagtccctta atccccaggc tgacatgcaa ctcctgagct
cgaacattgc cccaccttag ctttcataag actcaaaccg acctgaaggg agggaaaaaa
aagcccaatt ctagcccacc acgcttctgc ttaaccgacg ggaaggaaaa ctgtacaaga
cccaagaaga atcgctgtga tgaccacagt tgagtggcat agatacagct aatgaacacc
ctgccaccat caaggcctcc tgtaatatca gagaaataca ataacgtgtc atacaactca
gaactaattc aagaagtctc tagagcaacc aaagcaacaa attaggaaaa ataaagacac
ttggaacatt ctccaacctg ggatccctct ggctgtatca aacagtggac acatggtata
gccctcattt tcaaccacat caaacactgt atgtaaagct tactaaaaca aaaaaatctc
agctagaaaa tacagatcag aaccaaattc aggcgtggta gacatctgca aggattagat
ggtacatcta attatgatta acatggtaaa agtgctaaaa caaaacaaaa cggtagactg
gttttgaccc ccggacaagg gacagaagtg cttattttac atatcaatgc agacctggct
tccaggttct actagcagcg ttcagtccct gcctgatata ccttgttccc aaccttgaac
tttccagttc aggggcttag ctgcccttcc acaagacgtt cttccaatg ttatctagac
attttgcgcc ccacccttct cctctctgca cgagcgcacc ccttcttccc ttttctcctc
tcccctctcc ccatggcaac tcctcaatcc ttgaagccag tgaactcccc gagagcagtt
ccccaataag cctacctta atgcaatcgg acttgaatag tctcgtttca cgggcagaga
agtcattgat cggagacaac atgcatgaat aggagaccaa caccatcaac acaaccgatg
ctcaaaatca atagcattaa gaagtgagca ttcataaaga tttggaagct aacacttcag
agcacactcc agaagaacaa atggggtgtg aggggaaggg atttagttag ggattttgct
tgtcattggc ggtgcatctc tgcaatcccc caaatctgga aggctgagga ggatcagaag
ctcaaaggct gcctggaatg cgtggggaga atctccctct accaataaag agacaaacaa
tgccagacaa gcagaatgta tcaggagaca actggaaatg ggataaagat acaagataat
acctaaaacc taatggaatg aatgaagcta aagccgcaca aaggtgtgtg tattgggggg
tggggggagt tacagatgcg cattcctaag gaaggaatct ctgagtcacc accacctgca
ggaaaacctt ggcagaaaac agaaatgaca aaggctcgag cgtaaataca aaattttaaa
atgctgtttt tcttgaaaaa aaatttttt taagaagctg atgaaactaa gctacaccaa
taacaaactc aaatcacgtt tgcaaaagga gaccttacaa tcagtcaatg cttaaaatct
ctcaagagcc gaagcagaag ggatgctatc taactcaatt catgatgcca gagtgatcct
```

Fig. 7-3

```
gatatcaaag ccagaaagag acacaaaaga aagttaaaaa tttatagccc acatccctga
tgatcatcat cattacaata tccataaccc gagtttgatg gaattaaaat atccaggtgg
gatttactca tggaatgcaa gaatgattca acatacaaaa atcaatgaac acgatatcac
cacaatacaa tgacgatcat cttgatagca ttaaaacaaa aacaaacaaa caaacaaaca
aacaaacaaa aaaacccacg gggctgggga gatggctcag cggttaagag caccaactgc
tcttctgaag gtcgtgagtt caaatcccag caaccacatg gtggctcaca accatccata
atgagatctg atgccttctt ctggtgcatc tgaagacagc tacagtgtac ttacatataa
caaataaata aattaaaaaa aaaacacttg gaaaaactca gtgtactcat gattaaaaac
tctcggtaaa ccaggaatag gaggaaattg tctgagtaca taagggccac attgaaaaag
cccacagcta acatggtcaa tggtgaaaaa ttgagtgctt tcccttttaat aagatgaagg
aaccaagaat gtttgctctc ttagattcca atcctaatag aattgatggt cctgtgcaga
acagttgggg aagaaaagga atccagggct gggactgtac cacagtctgt agaatgcttt
tctctagaat gcataaagcc ctatgtgcaa tcccaatagt ggtacaagcc tatgaccctg
atactcagga cgtagaagct agaggatcac aattcaacgt tacctgggc taaagaccct
gttttacttt attacttttt ttttttttaa tatctgaatt gtaactgact ggagtactct
gctcacaaat gccatgatta tttatgtggg ggacttacga aagtctacac acacatacac
acacacacac acacacatac acacacacca tacaactcag gtaattcagc tgtaaagtta
taggatacaa aatgagtata taaagtgaa ttgagggcca ctgagatggc tgagcaatta
caaacacttg cccccaagtt tgaagacctg agttttttgtt tgatacagcc ctggctggct
tggaaattac tatgtagacc aggctggcta ccaatttatt taagatctgt ctgcctctgc
ctttgagtcc tgggattaaa ggtgcaagcc actacagcaa acttggtgtt atagtttaaa
tatatggttt actcctagca acttgtatgt tgtcttggtg ctgaaatgtg gtggcatctt
taagagggtt taattaattt ctcaagagcc tagctgagtt cttggatttt aagaagaggt
tgctataaaa tgatcctagc atctacctga tagctcttgt gcatatatta tactggacaa
aatagatgtt tccctaccac aactctccta tgagttaaca ctgcttccaa ccagaaactg
agaaaatcct ggccagcaca gtcttgaatg tctctgtttc cagaattgtg acctaaattt
atctttacta ttcatgactt aatctaggtt gaggaatgtt gctataacaa aaaataatct
gagataattg ctctgactag aacatttaat attgttaaaa tactacttct gttcaaagtg
atctgtagag tcaatcaata tctatcgcac tcccaatggg ttttttgtttg ttttcttttt
gtattttgga agtagcaaaa ataactataa aatacatata gatgcgtgaa gacccatgaa
cagccaaaat aatcctgaaa aagaacagct cttgtccaat ggaccttggg ggaaaccaaa
cgtcacattt tacacagagc aggataaggt attggttttc attttgcctc tccagaacac
aaaacctaga ttttttttgtt tgtttgttca tctgttttaa tagggcctca tcttagcct
gggcttacct tgaatttgga gtctgcctcc ctcagttgct atagttctgg gattataggc
ataaggtgca atttccagca aaaatccttt aagggctgct tgaaactcac tatgtagctc
agcctggcct caaactcata accatcctct caagtgctag gattacatga atgagccaca
gtagcagcta aaacccttta cattttatta gggtatattc tatacaatat gagtgccatt
ataacatcac atacacgtaa gattttgttc ctattcactc ccattactct ctttttttct
ccctctcact tttactgatc cccttactct gctcacacac ttctgatttc tggtttcttc
tatagcatgg atgaagggtt atttacagga acatggcaga ttcttaccga agaaagtatc
```

Fig. 7-4

```
cccccctccc aactccctca gcaaacaata actactaata cccattctgc agggaggaat
gaggcatctt ggtcccttac gtctagacac tgttaactgc ctcctcgggg agggatgagg
ccttgtgagc ctcttgtagc aactgttaac ttcctacaca tcctaaggaa tgtggggtc
cccttgtata cacaggcctt gggtaggta atcataggtg ctgtgagttt atgagtatga
ctgctgctgt atgttccaca atacccatc ccttcttcca gctttacctt tctgccctct
ttgctgtggt gtttcttgaa ccttgcaagg gaggagatgc agatcccatt agggctgatc
ttcaacaatc acacaatcac atattctttt ttgtttgttt gtttgtttgt ttgttttttt
gagatagggt ttctctgtgt agctctggct gtcctggaac tcactctgta gaccaggctg
gcctcgaact cagaaatctg cctgcctctg cctcccgagt gctgggatta aaggcacgcc
cagccaatca catattctta tgactcagag ctaaaagtct gcacgaacag aaactagtct
taccaaagct gacagtagca caaatctaca ggtataaaca tacatggtta gaagacaatt
tgatagtcat aaggtggcca gctagggagg caatagtggt aaagcttctc cattagagcc
tatggtctcc ccagctagag gcttttgaca aggcatgaac tttctcctag caagtgagcc
tcaactccaa tcagaaagtt aattagccaa ataaaaaaaa tggtaccctg tgctcagctt
ggcctgtgag taaatctgtg ggacattttc tcggttaacg atcgactggg gggggggca
gtccacttaa accatgtggg tggagccacc catggacagg tggtcctggg aggtatgaaa
aagcaaagtg agcaagccat ggggagcaag ccaggaagct gtcctttgtg gttcctgccc
taatttctac tgtgatgtgg aagtacaagc cagataaacc tttcctaccc aatgtatttt
tggttagaat gttttatcac agtaatagaa agcaaactaa aaactaaaac atctttctaa
ctttcatgcc acagtttctt tttcttcctt tcttttttct tttcttcttt ttcttttctt
tttttttttt ttttttttgg ttttcgaga cagggtttct ctgtatagcc ctggctgtcc
tggaactcac tctgtagacc aggctggcct cgaactcaga atccacctg cctctgcctc
ccaagtgctg ggattaaagg catcgccac cactgcccgg ctgcatttt tttttaaat
taaaaaagtt gaacctaggt gtgttgtctc gtgcctgtaa tgcccatgtt caggagagag
agagagggag ggcagggtga ttactatgac ttcaacatca gcatgcgctt acatcatcag
ttagaggcca gtctgggata cagagtgaga acctgtctca aacaaaaac aaaaaaacaa
aaaacaaaac aaaacatcaa ctatcataag tgacttaaat aatggatatt aaacctaaat
atcacacaac ttcacttaag aaaattctga ggactggaaa gatggctcaa tgattcaaag
tgctttccgg aggaagcctg aacaccacag tttgagtcct aacacttta tataataagc
taagtgtggg cccatgcatc cctataagtc cagcactgag gctagcagag actggaggat
taacaaggca acaggcaga cacggtaaca gcctcttcat gcatgcacta gctcacacac
atgagtgcgc gtacatcaca aacacaagca cacacaataa atacatttaa aagttttttc
tttctttgta agtgtgaaaa ttacaaattg tagaattttg atccagataa gaggatcagg
agtttgaggc tagcctggg tacataagac cctgtttcaa aaccaaact aaaccaaaac
acacacacac acacaaagtt gacacaaatt ttcaccatgt attcgacgtg tcaaggctca
cctggtcat gcaagactaa ataaattaat tgtaactaaa tgcaagacta aatgtctaaa
gtattttga aagtctggct taatgcaatt tgcttcggtg ttttgtcaga tgacaagtta
gataggtcat tcatgcttgt ttacgaacaa gacaagtaaa attcctcgag tctctgtctc
ttggaatagg tctttccact gtaggtggga gggaaatgtt tccgtctccc aagtgctgga
atttaaaggt gtgggtctgg ttgaactcgt tttttgtgtc cttcagtggt caggtgcccc
```

Fig. 7-5

```
ggctggtggg tggggtggga ggaggagtat ctgtctctat tgttcctgga ctgatcctga
agtgtaacgg aagtgaaagg aaggttgagt ggagggctag tggacagtga ctggcccaca
acactacctt taagaagaca aatggaccat agtgatgtac acctataatc ctagcaccca
agaggcagag gcaggaggat cactgagttc aaaaccgtcc tgatctacag agagagagag
ttcaaggaca accagggcta tacagagaaa ccctgtctct ggggggggaaa aaaagcaagg
aaaaaaggaa ggaaggaaag aaagaaagaa atgaagagaa agaaaaaaga ctaataggtc
ccagagactc ccatgacagt gggaagaag agtctgcaca cttcctcctg ctggaattct
tgataagaaa taacctccag agaaatggca atcatttaca atttatacca caaattatac
tacactggaa caccatagta ggccttagga gaaaaacaga cgcttaaaca tccctacttg
gaggcttttt gaaaacaaag taaattatct ttactgagca agaaaacact tggtgtctag
gtaaccctgt agcatgtgtg aacaaaagac tattgcccag acagagcctc aactttctcc
tttctattaa attcacagta aaaagcaaac atgtatagac ataagtaata aagtcaggtg
taggcataaa tcaccgcatc ttttctacaa aagtgagctt aagcgtttta ccttttagg
acagagtgaa aatccggaag ttgtcttctg attgtaacat gctgccacgg tcctccctgt
cactgctgcc attgggctat ggcctggtgt ctgtactcaa actgaaaact tgcaagctag
cacacgtgct ggcggagtgt ggacgcacgg gtacacgtgc gcacgcatga acacacacac
atgcacacac gcgtgcgcac agacacacac acacacacac acacacacac acacacacac
acacacacac acattttgcg catgcgtaca gatatgtgcg tgcgcacaca catacaggca
cacgcacaca tgcaagcgaa taaaattaaa atatggtagg cgcatggtag aacatgcctt
tgatcccagc atttggaggc agaagcaggc agaactctga atttaaatcc aatctggtct
aaaatatgag ttccagttca tccaggacca cgacaaaaag accctgtctc aaaaacacaa
atcacaaaat ggcaaaatga aacaaaacaa aatgaaaacc aaataaaata gaataagaa
ttctaccttc agctgagtgt gtgtttgtgt tatatatgaa tattgtgatg aatatctgta
atcccagaac tgaggacttt gagacagaag aattaggagt ttgaagccag cctggaaaag
atggccagat tatgactgtt tttctaaata ataagtaaag aaataaagaa aaggagaata
acaaccaagc atggtgataa attcgtgacc tcatcttcta tgtatatgat gtaaaagtca
tgaagtaata acctcttaca atattcaagt agtagcttta cttggaaaga aagattttaa
aagaaatttt attttagac agtcaaaaat ataattaaga agtatcgtat ctgtgctaag
cagacaatat aaaattcggg aacaaagaac atatatcttt atctgtttgc ttatttttat
ttatttattt atttacttac ttacttactt acttacctac ttattggaga cacatttttt
tctatgtaac agccctcact attctggaac tctccctgta gaccaggctg gcctcgaact
cacagagatt tgcctgcctc tgcctcccaa gtgctgggat tgaaggcctg tgccatcact
gcctggcact ttttctttct gtctctgtct ctgtctctgt ctgtatctct tccttccttt
ctgtctcttt ctttttttatc tttagtattt ttaaaggcat gttttttatct gctagctatt
tattttgag gtagagtctc acgatacagc ctcaactagc ctggaactca gaaagagcca
tcttcctccc cccaccacac ctggcaggtt ccttttaaag acattacttc tcaactcaaa
taatgctaaa atcaattgag ctgtttatca tctgactatt gttggttagc tagaaacttc
tgaagtgttg caatgttag ctaaagtcta gaatttgctg ttttttccatg tgttaagtgt
caggaaatgc gaggtaggta agtgtttgaa gatagtgtct gccattatac aaaatgctga
gtgataggct gattgagtgt acaaccaaac agatccagat agtcaccaac ttatttatta
```

Fig. 7-6

```
gttgctggac tggtttttac caaactatga ggaaaagtag gagggataaa aaagagtaat
agagggggtga atatgcaatt atgttatatg cattatggaa atagttaatg aaatctttac
tttgtacaaa tagtatacac taattaaaaa gatacaaata gctgatatgc aagataaata
agttttacag atctaatgta tacatagcac aggcactaca gttaatgata ctgtgttaga
tccttttttaa agaaaactct agttttgctg agcgtggtgg cacacgcctt taatcccagc
acttgggagg cagaggcagg cagatttctg agttcgaggc cagcctggtc tacaaagtga
gttccaggac agccagggct acacagagaa accctgtctc gaaaaaacaa aacaaaacaa
agagtactga ctgctcttct agaggtcctg agtccaattc ccagcaccta catggtggct
tacaaccatc tataattcca gttcttaggg gacattgaca ccttcttctg gcttctgtgg
acactgcaca gatatggtac ctaggtatgg cagccaaaac acccaagcac ataaaataaa
gataaataaa tattttttaaa aaggggggatg ggggtggaca gatggctcag cggttaagag
cattgactgc tcttccagag gacctgaatt caattcccag caaccacaca accatctgta
atgggatcta atgccttctt ctggtgtgtc tgaagacagc tacagtgtac tcaggaaaaa
aatagttttt tttttttttaa gaaagaaatt cagatatctg ctgtattgta ctctttatta
ctgccaggac aaaatgtcca gaacgataat tcaaaaatag cccactgact ttccacgtgc
tagaaggtag aaagtgatag cagatttcat gccatgcaga tgatccctgt ttccacagag
gtgcttctct cacaagacag aagaaatgga agagcaaaag acacaaccag gagtgtactt
ttagctgttc ttacaaggac agggacagta atcgagtcat ggaggcatta ccaaatacat
ccaaaaaggc cttatctttc ttgttgtttt tgttcggttg gttttggttt tgaggcaagg
ttttttcggtg tagttctggc tatcctggaa ttctggagtc aggctgacct cgaactcaca
aagatcctcc tgactctacc tcctgagtgg taggacaaaa gccgtgcacc atctgatcac
cctactcatg atgtgtgcat gcacacacac taataataac aagcaaaaaa tatctttaaa
aagtctaaaa ccacaacttt gagacagaca ttaggtagac atacttattc caaaagtcag
aaataggaaa gaagaaaggg ataaattacg ccaaataagc cccagacatg gcagggcaag
agttcgttct gtgtgcgcac gtgctccaaa gtgtttcatt acagttgctt tcagagtcct
gggtgagggg attatttgta ggagaatgga ctccctacaa gtagttacac actcagatct
tctctcccctt tctcaccaac tatagacccc ccaggggaggg gtggggtaac atcagctcct
cccaatagggg gaaggttttg ttggtgttgt gttgtgttgt gttgtgttgt gttgtttgag
acagtctatc actatgtagc ctgattggcc tggaattcat caggtagacc aggctggcat
ctaaatcaga gattcacctg cctctgtatt ttgactgctg ggattaaagg tatgtacacc
aacatattcc cctaagaggg gatggatccc agggtctaga tgccattgct ctctctcccc
tctctcttta taaatatagt tttaagattt ttacttgtat ttatcagtac aggggggtggg
ttgctggagt atgccagaag agagtattgg atcgcttgga gctagagtta cagggaattt
tgagacatct ggggactgaa tataagtccc ctgaggagca gcaccccaac atggtaatac
ttcatcttaa ggctcaagag caaactttgg ctccaagttc tgcctctaga cacacggagc
gccatttggg ttcacagggc tctaagcttg cctcgctagg cacgctgaca cagcacttct
tgtcagtcgg aaccagttgc tggcacctct cccaagctgt ttttgcatac tggtggctct
atagctctgg cgtcataact gagagcagtg ttttcatagc tcttttgggc attgctctca
ttgggggtct attctctggg caaaagtcgc taagcactgt gctggtagag actttatatc
agccttcctc tggttctctg cttggctctc aaaactcatg gaggaatcct ttgaaatcta
```

Fig. 7-7

```
ggtgaagcta gtcatgactc cacagctcat acgtttggag gcagcagttc cttgctaaat
tctactttgt gtgcattaat gtctcctaag caagtctagt agaaaatcct ttataatatc
aattgtagta cttcaagttt cttccgcatc acggcatcgg ctgagtaaca gtcccccaga
tagatggaac aatagaagat tacaaagtga gaaaggaag gaagtagaaa aactggtgtt
tacttggttc cagctgtttt ctgattcagg aagaaagggg ccgggcatac tctacccatt
tatagtaaga agattttttt gttttggtgg gttttcgag acagggtttc tctgtgtatc
cctggctgtc ctggaactca ctttgtagac caggctggcc tcgaactcag aaatctgcct
gcctctgcct cccgagtgct gggattaaag gcatgcgcca ccatgccacc acgcccggct
tgtagtaagg agatttaact gtaccatgta aggcaagagc tcctcatgtc agagttcaaa
aagtaaatgt gctgaaccat cacttggttt agaacagctt aagcccccag cccccactcc
acccccaaacc aaccccttgac tgtttaattg ctgataagga ataaaagccc tttcctataa
accactgttt gtttgtttgc aacgaaatca gagatttact atatggatat ttaaaaattc
agaatttggg ggctagagag atggcttaga ggttaagagc actggctgct cttccagagg
tccagagaac ccagtttcaa ttaccaacaa ccacatacag atcacagctg tctgtaactt
cagctctaag ggatcctata ccatcacaca gatatggatg caggcaaaaa agcatcaatg
cacatggaat aaaaataaat aaaattttta aatttggaa tttacaaata atgaagatcc
ctcactggtt cagccactca ccgaggtacc tcactccagc aatttcccct caccagactt
attcattttt aaagtttaga tgtttgaata tttattgtaa aacagcaagc acaatgattt
ctatttttat aattggtgac gtgatctgga aaaatacttc taattggtaa ggcaagagtg
attgcaatgc actcttcatt tttttctaac ttcttaaagt atcttctttt ttaaaattaa
aactttatta tagggctgg agagatggct cagtggttaa gagcactgac tgctcttcca
gaggtcctga gttcaattcc caggaacctc atagtggctc acaaccatct gtaatgagat
ctgatgccct cttctggtgt gtctgaagac agctacagtg tacttagata taataaataa
atctttaaaa aaaacccttta ctggaaggag ttacagagac aaagtttgga gctgatacaa
aaggatggaa catctagaga ctgccatatc cagggatcca tcccataatc agcctccaaa
cgctgacacc attgcataca ctagcaagat tttgctagaa ggaccctgat atagctgtct
ctagtgagac ttcgcctggg cctagcaaac atataagtgg atgctcacag tcagctattg
gatggtcaca gggcctccaa tggaggagct aaagaaagta cccaaggagc taagggatc
tgcaacccta taggtggaac aacaatatga actaaccagt accccccaga gctcgtgact
ctagctgcat atgtatcaaa agatggccta gtcggccatc actggaaaga gagcccatt
ggacatgcaa actttatatg ccccagtaca ggggaacgcc agggccaaaa agtgggagtg
gggggaaggg tatggggac ttttggata gcattggaaa tgtaaatgag gaaaatacct
aattaaaaaa aaaaacgggg cctagcaaac acagaagtgg atgatcacag ttagctattg
gatgggtcac acggccccca atggaggagc tagagaaatt acccaaggag ctaaagggaa
ctgcaaccct atagatggaa caacattatg aactaaccac taccccggag ctcttgactc
tagctgcata tgtatcaaaa gatggcctag tcggccatca ctgcaaagag aggcccattg
gacttgcaaa ctgtatatgc cccagtacag gggaacccca gggccaaaac gggggagtgg
gtgggtagtg gattgggggg ggtgggtatg gcggactttt gggatagcat tgaaaataaa
aaaaaaccctt tactataaaa aaacttgcaa ataaaaaatt acccaccgga gctaatgacc
agatctttaa tagttttgtt ttttatattg ttatagtgtt tgtgttctca gcacacttaa
```

Fig. 7-8

```
caaaagcaac agaaaatata agaaattaat ctactcaact aaactaatta aagtttattt
tgagacagga tctcactatg tagtcctgaa ctggaactca ctatgagcag ctggctttta
atttaaagac ccacaggttt ttgcctcttt tgcctctgga gtgctgggat taaaggcatg
agccagcagc atcccagact acattttaag aaagggaaaa aagctggtcg ccgggcatgg
tggcgcacgc cttaatccca gcactcggga ggcagaggca ggtgaatttc tgagttcgag
gccagcctgg tctacaaagt gagttccagg acagccaggg ctacacagag aagccttgtc
tctaaaaacc aactaaccaa ccaaaccaaa accaaaccaa accaaaaagg aaaggaaagg
aaaaaacgag gtaattagca taattagcat gacaaggaag gggtagtgag aaacagtgac
acagaaacgc aaaggtttca agcagaattt attggaagtt tggcaagcaa caaacaccct
agttggcctg tagatgactt tagattgttt tgcggtgatt ttcattttga agaaggattt
ccaattttca aaacagccag gctcaaatta agtatttccc atttatttta gcagtttggt
atagatttgt tttcggctta gtgtgtagag atgtttgttt gtttgtttgt ttgtctgttt
tccatcagga cttcatttat gcatgagggc acaatggtag ctgatggtga cacgtttctg
cctgcctgct taatcagtt
```

Fig. 7-9

ISOLATED STEM CELL COMPRISING A XIC FLANKING REGION TRANSGENE

STATEMENT AS TO FEDERALLY SPONSORED RESEARCH

This invention was funded in part by grant number RO1 GM58839 from the National Institutes of Health. The government may have certain rights in the invention.

BACKGROUND OF THE INVENTION

The present invention features improvements for the development and maintenance of mammalian stem cells and their derivatives.

Stem cells are unique cell populations that have the ability to divide (self-renew) for indefinite periods of time, and, under the right conditions or signals, to differentiate into the many different cell types that make up an organism. Stem cells derived from the inner cell mass of the blastocyst are known as embryonic stem (ES) cells. Stem cells derived from the primordial germ cells, and which normally develop into mature gametes (eggs and sperm), are known as embryonic germ (EG) cells. Both of these types of stem cells are known as pluripotent cells because of their unique ability to differentiate into derivatives of all three embryonic germ layers (endoderm, mesoderm, and ectoderm).

The pluripotent stem cells can further specialize into another type of multipotent stem cell often derived from adult tissues. Multipotent stem cells are also able to undergo self-renewal and differentiation, but unlike embryonic stem cells, are committed to give rise to cells that have a particular function. Examples of adult stem cells include hematopoietic stem cells (HSC), which can proliferate and differentiate to produce lymphoid and myeloid cell types, bone marrow-derived stem cells (BMSC), which can differentiate into adipocytes, chondrocytes, osteocytes, hepatocytes, cardiomyocytes and neurons, and neural stem cells (NSC), which can differentiate into astrocytes, neurons, and oligodendrocytes. Multipotent stem cells have also been derived from epithelial and adipose tissues and umbilical cord blood (UCB).

A considerable amount of interest has been generated in the fields of regenerative medicine and gene therapy by recent work relating to the isolation and propagation of stem cells. The ability of stem cells to be propagated indefinitely in culture combined with their ability to generate a variety of tissue types makes the therapeutic potential from these cells almost limitless.

One of the major limitations in the development of stem cells for therapeutic purposes concerns the regulation of the transition from self-renewal to differentiation for a sufficient time to allow the clinician or researcher to manipulate the cells for therapeutic or research purposes. Current methods used for maintaining stem cells in the undifferentiated state include growing the cells on a feeder layer of mouse embryonic fibroblast cells, culturing in bovine serum, culturing in a plate-coating matrix of cells extracted from mouse tumors, and adding reagents such as leukemia inhibitory factor, fibroblast growth factor (FGF), the Map kinase kinase inhibitor PD 98059, and Oct-4 (also known as Oct-3/4). All of these methods are limited in their potential because of their inefficiency in blocking differentiation and because of the potential contamination with animal products, pathogens, feeder cells, or, in the case of human stem cells, contamination with non-human cells.

Improved methods for the growth and manipulation of undifferentiated stem cells are needed to help realize the full therapeutic potential of these cells.

SUMMARY OF THE INVENTION

The present invention is based on the discovery that X-chromosome inactivation (XCI) enables differentiation in stem cells and that inhibiting or blocking XCI can result in a block to differentiation, thereby providing a mechanism for controlling differentiation of stem cells. Such methods include targeting and inactivating any of the endogenous genes within the X-inactivation center locus or introducing transgenes that can prevent the cells from undergoing X chromosome inactivation. The use of these methods to control stem cell differentiation facilitates and enhances the therapeutic and clinical potential of stem cells.

XCI is the process in which one X-chromosome is shut off in the female cell (XX) to compensate for having an extra X-chromosome as compared to the male (XY) cell. This means that every embryo must be equipped with a mechanism to count X-chromosomes (XX vs. XY), and then randomly choose between two X-chromosomes in the female to start the inactivation process while maintaining the same X-chromosome inactive in all later divisions. The steps are respectively known as "counting," "choice," and "silencing." In addition, interchromosomal pairing is also involved in the XCI process.

These steps are controlled by a master regulatory region called the X-inactivation center (Xic), which contains a number of unusual noncoding genes that work together to ensure that XCI takes place only in the XX female, only on one chromosome, and in a developmentally specific manner. At the Xic, three noncoding genes, Xist, Tsix, and Xite, are involved in this process and each makes RNA instead of protein. Xist is made only from the future inactive X and makes a 20 kb RNA that "coats" the inactive X, thereby initiating the process of gene silencing. Tsix is the antisense regulator of Xist and acts by preventing the spread of Xist RNA along the X-chromosome. Thus, Tsix designates the future active X. Xite works together with Tsix to ensure the active state of the X. Xite makes a series of intergenic RNAs and assumes special chromatin conformation. Its action enhances the expression of antisense Tsix, thereby synergizing with Tsix to designate the future active X. Together Tsix and Xite control the "choice" step, while Xist controls the "silencing" step. Tsix and Xite also regulate counting and mutually exclusive choice through X-X pairing.

The present invention is based on the discovery that disruptions in the XCI process, either by an excess or a depletion of Xic, Tsix, and Xite, or sequences flanking the Xic region can block differentiation. In the present methods, disruptions in the XCI process are achieved through the use of transgenes or small RNAs derived from Xic, Tsix, Xite, or Xic flanking region sequences, or fragments thereof, that are introduced into stem cells and prevent the stem cells from undergoing X chromosome inactivation and from differentiating in culture. Removal of the transgene reverses the block to differentiation and the stem cells can be induced to differentiate as desired. These methods allow the clinician or investigator sufficient time to manipulate the stem cells as needed to enhance their therapeutic potential in the absence of contamination with cells or animal products. The use of small RNA molecules circumvents the need for removal of the transgene because the small RNA molecules have a limited half-life and will naturally degrade. The methods of the invention also reduce or eliminate the need to use feeder cells which also results in cells that are more suitable for therapeutic purposes due to the reduced likelihood of contamination by feeder cells. Thus, these methods and the cells produced from these methods overcome two of the major limitations to stem cell research.

Accordingly, in a first aspect the invention features a method for delaying differentiation of a stem cell that includes introducing into the stem cell at least one transgene selected from the group consisting of an Xic transgene, a Tsix transgene, an Xite transgene, a Tsix/Xite transgene, an Xic flanking region transgene, and any fragments thereof.

In another aspect, the invention features a method of controlling differentiation of a stem cell that includes the steps of (a) introducing into the stem cell at least one transgene selected from the group consisting of an Xic transgene, a Tsix transgene, an Xite transgene, a Tsix/Xite transgene, an Xic flanking region transgene, and fragments thereof, thereby delaying differentiation of the stem cell and (b) when desired, inactivating the transgene thereby allowing differentiation of the stem cell. In this method the transgene can further include a selectable marker. The transgene can also be flanked by recombinase recognition sequences including but not limited to LoxP or FRT sequences. In step (b) of the method, inactivating the transgene can include removing the transgene from the stem cell, for example by expression of a recombinase (e.g., Cre recombinase or flippase (FLP) recombinase) in the stem cell to remove the transgene from the genomic DNA or to remove an episome containing the transgene (e.g., by deleting the origin of replication). In preferred embodiments, the recombinase expression is transient. The method can also include the introduction of a second transgene into the stem cell prior to the inactivation step. If desired, more than one additional transgene can be introduced into the stem cell prior to the inactivation step.

In another aspect, the invention features a method for delaying differentiation of a stem cell that includes introducing into the stem cell a small RNA substantially identical to or complementary to at least 15 nucleotides of a transgene selected from the group consisting of an Xic transgene, a Tsix transgene, an Xite transgene, a Tsix/Xite transgene, an Xist transgene, an Xic flanking region transgene, and any fragments thereof. The small RNA molecule can be a double stranded RNA or an siRNA molecule. The small RNA is at least 15 nucleotides, preferably, 17, 18, 19, 20, 21, 22, 23, 24, 25, 26, 27, 28, 29, 30, 31, 32, 33, 34, or 35, nucleotides in length and even up to 50 or 100 nucleotides in length (inclusive of all integers in between). Desirably, the small RNA molecule is 15 to 32 nucleotides in length.

For any of the above aspects, preferred Xic transgenes include any nucleic acid sequence substantially identical to SEQ ID NOs: 1, 2, 3, 39, or any fragments thereof. Preferred Tsix transgenes include any nucleic acid sequence substantially identical to SEQ ID NOs: 5, 6, 9, 10, 12, 13, 14, 21, 22, 23, 28, 29, 30, 31, 32, 36, 40, or any fragments thereof. Particularly preferred Tsix transgenes include the nucleic acid sequences set forth in SEQ ID NOs: 9, 10, 12, 21, 22 and 28-32. Additional preferred Tsix transgenes include at least one copy, at least two copies, at least three copies, at least four copies, and at least five copies of any of SEQ ID NOs: 13, 14, 28-32, or 40. Preferred Xite transgenes include any nucleic acid sequence substantially identical to SEQ ID NOs: 15, 16, 17, 24, 25, 26, 27, 38, or any fragments thereof. Preferred Tsix/Xite transgenes include any nucleic acid sequence substantially identical to SEQ ID NOs: 4, 11, 19, 37, or any fragments thereof. Preferred Xic flanking region transgenes include nucleic acid regions surrounding the Xist and Xite sequences. These Xic flanking region transgenes include any nucleic acid sequence that is substantially identical to SEQ ID NOs: 46-48 (three contiguous sequences that encompass the mouse Xic and the Xic flanking regions), 49-50 (sequences flanking the Xic and upstream of Xist) or 51-52 (sequences flanking the Xic and upstream of Xite), or any fragment thereof. Preferred transgenes for any of the above regions can inhibit endogenous X-X pairing, for example, by inducing de novo pairing between the X and the transgene, as assayed using the methods described herein or in PCT Application No. PCT/US06/25800.

Any of the transgenes can be used in combination with any additional transgene. In one example, SEQ ID NO: 23 can be used in combination with any of the additional transgenes to enhance the block to differentiation. In addition, the transgenes can be used as a single copy or as a multimer (e.g., multiple copies or a tandem array of the sequence). For example, SEQ ID NOs: 13, 14, 28-32, and 40 are particularly useful as multimers. In addition, SEQ ID NOs: 49-50 and 51-52 can be used together in any combination with each other or any of the additional transgenes to enhance the block to differentiation.

In preferred embodiments of the above aspects, the stem cell is an embryonic stem cell, desirably a female embryonic stem cell. Mammalian embryonic stem cells or embryonic stem cells from any agricultural animal are particularly useful in the methods of the invention. In preferred embodiments the stem cell is a human or mouse embryonic stem cell. The stem cell can be an embryonic stem cell at any stage, preferably a blastocyst stage stem cell, an embryonic germ cell, or a cloned stem cell from a somatic nuclei.

In another aspect, the invention features a stem cell that includes an Xic transgene substantially identical to a nucleic acid sequence set forth in SEQ ID NOs: 1, 2, 3, 39, or any fragments thereof.

In yet another aspect, the invention features a stem cell that includes a Tsix transgene substantially identical to a nucleic acid sequence set forth in SEQ ID NOs: 5, 6, 9, 10, 12, 13, 14, 21, 22, 23, 28-32, 36, 40, or any fragments thereof.

In yet another aspect, the invention features a stem cell that includes an Xite transgene substantially identical to a nucleic acid sequence set forth in SEQ ID NOs: 15, 16, 17, 24, 25, 26, 27, 38, or any fragments thereof.

In yet another aspect, the invention features a stem cell that includes a Tsix/Xite transgene substantially identical to a nucleic acid sequence set forth in SEQ ID NOs: 4, 11, 19, 37, or any fragments thereof.

In another aspect, the invention features a stem cell that includes an Xic flanking region transgene substantially identical to a nucleic acid sequence set forth in SEQ ID NOs: 46-48 (three contiguous sequences that encompass the mouse Xic and the Xic flanking regions), 49-50 (sequences flanking the Xic and upstream of Xist) or 51-52 (sequences flanking the Xic and upstream of Xite), or any fragment thereof.

In preferred embodiments of the above aspects, the transgene is expressed in the stem cell. Desirably, the stem cell is an embryonic stem cell, which can be male or female, preferably a female embryonic stem cell. Mammalian embryonic stem cells or embryonic stem cells from any agricultural animal are particularly useful in the methods of the invention. In preferred embodiments the stem cell is a human or mouse embryonic stem cell. The stem cell can be an embryonic stem cell at any stage, preferably a blastocyst stage stem cell, an embryonic germ cell, or a cloned stem cell from a somatic nuclei.

For any of the stem cells of the invention, the transgene can further include a selectable marker or be flanked by LoxP or FRT sequences. The stem cells of the invention can also include a recombinase (e.g., Cre or FLP recombinase), preferably one that is expressed transiently. Any of the stem cells of the invention can also further include a second transgene, or if desired additional transgenes.

In another aspect, the invention features an isolated small RNA molecule comprising a nucleic acid sequence substantially identical to or complementary to at least 15 nucleotides of a transgene selected from the group consisting of an Xic transgene, a Tsix transgene, an Xite transgene, a Tsix/Xite transgene, an Xist transgene, an Xic flanking region transgene, or any fragments thereof. The small RNA molecule can be a double stranded RNA or an siRNA molecule, and is at least 15 nucleotides, preferably, 17, 18, 19, 20, 21, 22, 23, 24, 25, 26, 27, 28, 29, 30, 31, 32, 33, 34, or 35 nucleotides in length and even up to 50 or 100 nucleotides in length (inclusive of all integers in between). In one embodiment, the small RNA molecule is an siRNA 15 to 32 nucleotides in length.

In a related aspect, the invention features a composition that includes the small RNA molecule described above formulated to facilitate entry of the small RNA into a cell. In another aspect, the isolated small RNA molecule described above is in a pharmaceutical composition. The pharmaceutical composition can further include a pharmaceutically acceptable carrier. The invention also features a vector that includes the small RNA molecule, wherein the small RNA molecule is operably linked to one or more transcriptional regulatory sequences.

For either of the above aspects relating to small RNAs, the RNA molecule is substantially identical to or complementary to any of the following preferred transgenes. Preferred Xic transgenes, which include any nucleic acid sequence substantially identical to SEQ ID NOs: 1, 2, 3, 39, or any fragments thereof. Preferred Tsix transgenes include any nucleic acid sequence substantially identical to SEQ ID NOs: 5, 6, 9, 10, 12, 13, 14, 21, 22, 23, 28, 29, 30, 31, 32, 36, 40, or any fragments thereof. Particularly preferred Tsix transgenes include the nucleic acid sequences set forth in SEQ ID NOs: 9, 10, 12, 21, 22 and 28-32. Preferred Xite transgenes include any nucleic acid sequence substantially identical to SEQ ID NOs: 15, 16, 17, 24, 25, 26, 27, 38, or any fragments thereof. Preferred Tsix/Xite transgenes include any nucleic acid sequence substantially identical to SEQ ID NOs: 4, 11, 19, 37, or any fragments thereof. Preferred Xist transgenes include any nucleic acid sequence substantially identical to or complementary to SEQ ID NOs: 7, 8, 20, and 35. Preferred Xic flanking region transgenes include any nucleic acid sequence that is substantially identical to SEQ ID NOs: 46-48 (three contiguous sequences that encompass the mouse Xic and the Xic flanking regions), 49-50 (sequences flanking the Xic and upstream of Xist) or 51-52 (sequences flanking the Xic and upstream of Xite), or fragments thereof. (See Augui et al. *Science* 318:1632-1636 (2007) for additional information on the Xic flanking regions.)

By "stem cell" is meant any cell with the potential to self-renew and, under appropriate conditions, differentiate into a dedicated progenitor cell or a specified cell or tissue. Stem cells can be pluripotent or multipotent. Stem cells include, but are not limited to embryonic stem cells, embryonic germ cells, a cloned stem cell from a somatic nuclei, adult stem cells, and umbilical cord blood cells.

By "adult stem cell" or "somatic stem cell" is meant an undifferentiated cell found in a differentiated tissue that can renew itself and (with certain limitations) differentiate to yield all the specialized cell types of the tissue from which it originated. Adult stem cells are multipotent. Non-limiting examples of adult stem cells include hematopoietic stem cells, bone marrow-derived stem cells, and neural stem cells (NSC), as well as multipotent stem cells derived from epithelial and adipose tissues and umbilical cord blood (UCB).

By "embryonic stem cell" is meant a cell, derived from an embryo at the blastocyst stage, or before substantial differentiation of the cell into the three germ layers, that can self-renew and that displays morphological characteristics of undifferentiated cells, distinguishing them from differentiated cells of embryonic or adult origin. Exemplary morphological characteristics include high nuclear/cytoplasmic ratios and prominent nucleoli under a microscope. Under appropriate conditions known to the skilled artisan, embryonic stem cells can differentiate into cells or tissues that are derivatives of each of the three germ layers: endoderm, mesoderm, and ectoderm. Assays for identification of an embryonic stem cell include the ability to form a teratoma in a suitable host or to be stained for markers of an undifferentiated cell such as Oct-4.

By "differentiation" is meant the process whereby an unspecialized early embryonic cell acquires the features of a specialized cell such as a heart, liver, bone, nerve, or muscle cell. Differentiation can also refer to the restriction of the potential of a cell to self-renew and is generally associated with a change in the functional capacity of the cell. The terms "undifferentiated," or "delaying" or "blocking" differentiation, are used broadly in the context of this invention and include not only the prevention of differentiation but also the altering or slowing of the differentiation process of a cell. It will be understood by the skilled artisan that colonies of undifferentiated cells can often be surrounded by neighboring cells that are differentiated; nevertheless, the undifferentiated colonies will persist when the population is cultured or passaged under appropriate conditions, and individual undifferentiated cells will constitute a substantial portion (e.g., at least 5%, 10%, 20%, 40%, 60%, 80%, 90% or more) of the cell population. Differentiation of a stem cell can be determined by methods well known in the art and these include analysis for cell markers or morphological features associated with cells of a defined differentiated state. Examples of such markers and features include measurement of glycoprotein, alkaline phosphatase, and carcinoembryonic antigen expression, where an increase in any one of these proteins is an indicator of differentiation. Additional examples are described herein. In preferred embodiments, if less than 10%, 5%, 4%, 3%, 2%, or 1% of the cells in a population express a marker or morphological feature of differentiation after an established number of days in culture (e.g., 2, 3, 4, 5, 6, or 7 days or more), then the cells are undifferentiated. Differentiation can also be determined by assays for X chromosome inactivation. Examples of such assays are described herein and include measurement of Xist expression by fluorescent in situ hybridization (FISH) or RT-PCR or measurement of interchromosomal distances by FISH (X-X pairing). In one example, if after an established number of days in culture (e.g., 2, 3, 4, 5, 6, or 7 days or more), fewer than 20%, 15%, 10%, 5%, 4%, 3%, 2%, or 1% of the cells in a population show an increase in Xist expression as measured by FISH or RT-PCR or show X-X pairing as measured by FISH, then the cells are undifferentiated.

By "fragment" is meant a portion of a nucleic acid molecule that contain at least 1%, 5%, 10%, 20%, 30%, 40%, 50%, 60%, 70%, 80%, or 90% of the entire length of the reference nucleic acid molecule. In the present invention, a fragment includes any fragment of the X inactivation center (Xic) or the Xic flanking region (e.g., SEQ ID NOs: 46-52) that includes at least 10, 17, 18, 19, 20, 21, 22, 23, 24, 25, 26, 27, 28, 29, 30, 31, 32, 33, 34, 35, 40, 50, 60, 68, 70, 80, 90, 100, 200, 300, 400, 500, 600, 700, 800, 900, 1000, 1500, 2000, 3000, 3700, 4000, 5000, 10,000, 15,000, 19,500, 20,000, or more nucleotides up to the entire length of the Xic (approximately 100 kB) or the Xic flanking region (approximately 700 kB). Preferred fragments are described herein and are shown in Tables 1 and 2 and FIGS. 1, 2, 3A, 3B, and 10B. One preferred fragment is a small RNA nucleic acid sequence, often called siRNA, which can serve as a specificity determinant in the RNA interference (RNAi) pathway.

"RNAi," also referred to in the art as "gene silencing" and/or "target silencing", e.g., "target mRNA silencing"), refers to a selective intracellular degradation of RNA. RNAi occurs in cells naturally to remove foreign RNAs (e.g., viral RNAs). Natural RNAi proceeds via fragments cleaved from free dsRNA which direct the degradative mechanism to other similar RNA sequences. Alternatively, RNAi can be initiated by the hand of man, for example, to silence the expression of target genes. The unifying features of RNA silencing phenomena are the production of small RNAs, at least 15 nt in length, preferably 15-32 nt, most preferably 17 to 26 nt in length, that act as specificity determinants for down-regulating gene expression and the requirement for one or more members of the Argonaute family of proteins (or PPD proteins, named for their characteristic PAZ and Piwi domains). Recently it has been noted that larger siRNA molecules, for example, 25 nt, 30 nt, 50 nt, or even 100 nt or more, can also be used to initiate RNAi. (See for example, Elbashir et al. (*Genes & Dev.*, 15:188-200, 2001), Girard et al. (*Nature* 442:199-202 (2006), Aravin et al. (*Nature* 442:203-207 (2006)), Grivna et al. (*Genes Dev.* 20:1709-1714 (2006)), and Lau et al. (*Science* 313:363-367 (2006)).

The term "small RNA" is used throughout the application and refers to any RNA molecule, either single-stranded or double-stranded" that is at least 15 nucleotides, preferably, 17, 18, 19, 20, 21, 22, 23, 24, 25, 26, 27, 28, 29, 30, 31, 32, 33, 34, or 35, nucleotides in length and even up to 50 or 100 nucleotides in length (inclusive of all integers in between). Preferably, the small RNA is capable of mediating RNAi. As used herein the phrase "mediates RNAi" refers to (indicates) the ability to distinguish which RNAs are to be degraded by the RNAi machinery or process. Included within the term small RNA are "small interfering RNAs" and "microRNA." In general, microRNAs (miRNAs) are small (e.g., 17-26 nucleotides), single-stranded noncoding RNAs that are processed from approximately 70 nucleotide hairpin precursor RNAs by Dicer. Small interfering RNAs (siRNAs) are of a similar size and are also non-coding, however, siRNAs are processed from long dsRNAs and are usually double stranded (e.g., endogenous siRNAs). siRNAs can also include short hairpin RNAs in which both strands of an siRNA duplex are included within a single RNA molecule. Small RNAs can be used to describe both types of RNA. These terms include double-stranded RNA, single-stranded RNA, isolated RNA (partially purified RNA, essentially pure RNA, synthetic RNA, recombinantly produced RNA), as well as altered RNA that differs from naturally occurring RNA by the addition, deletion, substitution and/or alteration of one or more nucleotides. Such alterations can include addition of non-nucleotide material, such as to the end(s) of the small RNA or internally (at one or more nucleotides of the RNA). Nucleotides in the RNA molecules of the present invention can also comprise non-standard nucleotides, including non-naturally occurring nucleotides or deoxyribonucleotides. Small RNAs of the present invention need only be sufficiently similar to natural RNA that it has the ability to mediate RNAi.

By the process of "genetic modification" or "genetic alteration" is meant the introduction of an exogenous gene or foreign gene into mammalian cells. The term includes but is not limited to transduction (viral mediated transfer of host DNA from a host or donor to a recipient, either in vivo or in vitro), transfection, liposome mediated transfer, electroporation, calcium phosphate transfection or coprecipitation. Methods of transduction include direct co-culture of cells with producer cells or culturing cells with viral supernatant alone with or without appropriate growth factors and polycations.

The term "identity" is used herein to describe the relationship of the sequence of a particular nucleic acid molecule to the sequence of a reference nucleic acid molecule. For example, if a nucleic acid molecule has the same nucleotide residue at a given position, compared to a reference molecule to which it is aligned, there is said to be "identity" at that position. The level of sequence identity of a nucleic acid molecule to a reference nucleic acid molecule is typically measured using sequence analysis software with the default parameters specified therein, such as the introduction of gaps to achieve an optimal alignment (e.g., Sequence Analysis Software Package of the Genetics Computer Group, University of Wisconsin Biotechnology Center, 1710 University Avenue, Madison, Wis. 53705, BLAST, or PILEUP/PRETTYBOX programs). These software programs match identical or similar sequences by assigning degrees of identity to various substitutions, deletions, or other modifications.

A nucleic acid molecule is said to be "substantially identical" to a reference molecule if it exhibits, over its entire length, at least 51%, preferably at least 55%, 60%, or 65%, and most preferably 75%, 85%, 90%, 95%, 96%, 97%, 98%, 99% or even 100% identity to the sequence of the reference molecule. For nucleic acid molecules, the length of comparison sequences is at least 10, 17, 18, 19, 20, 21, 22, 23, 24, 25, 26, 27, 28, 29, 30, 31, 32, 33, 34, 35, 40, 50, 60, 68, 70, 80, 90, 100, 200, 300, 400, 500, 600, 700, 800, 900, 1000, 1500, 2000, 3000, 3700, 4000, 5000, 10,000, 15,000, 19,500, 20,000, or more nucleotides up to and including the entire length of the Xic (approximately 100 kB for the mouse Xic) or the Xic flanking regions (approximately 700 kB in total which includes 325 kB upstream of Xist up to the beginning of the mouse Xic and approximately 290 kB upstream of Xite and downstream of Xist).

It should be noted that while protein-coding genes that are homologous generally share a significant level of homology (generally greater than 70%), the overall level of homology for noncoding genes and cis regulatory elements, such as the regions included in the present invention, is generally less than 60%. For example, the same Xic from different strains of mice have sequence variation on the order of one nucleotide change per 100 nucleotides. In another example, for the DxPas 34 repeats, the repeat length varies from strain to strain from 15-40 nucleotides. In yet another example, within Xite in particular, the sequence variation between strains can include basepair insertions, deletion, and single nucleotide polymorphisms. Furthermore, homology for noncoding genes and cis regulatory elements is often limited to smaller domains (e.g., 30 to 100 nt in length). As a result, more sensitive methods such as PipMaker analysis and Bayesian block analysis can be used to measure the homology or identity of a particular noncoding gene region or cis regulatory element (Schwartz et al., *Genome Research* 10: 577-586 (2000)).

By "inactivating the transgene" is meant reducing or eliminating the ability of the transgene to block differentiation or XCI. In one example, inactivation of the transgene can be achieved through removal of the transgene (e.g., using a site specific recombinase and DNA recognition sequences flanking the transgene). In another example, if a viral vector is used for introduction of the transgene into the cell, removal of the origin of replication (e.g., using a site specific recombinase and DNA recognition sequences flanking the origin of replication) can result in a loss of the viral sequences, including the transgene, after propagation. Inactivation of the transgene can be measured using the assays for differentiation, XCI, or nucleation of interchromosomal pairing as described herein.

By "isolated" is meant substantially free of other cellular material, or culture medium when produced by recombinant techniques, or substantially free of chemical precursors or other chemicals when chemically synthesized.

By "nucleic acid molecule" is meant any chain of nucleotides or nucleic acid mimetics. Included in this definition are natural and non-natural oligonucleotides, both modified and unmodified.

By "pharmaceutically acceptable carrier" is meant a carrier that is physiologically acceptable to the treated mammal while retaining the therapeutic properties of the compound with which it is administered. One exemplary pharmaceutically acceptable carrier substance is physiological saline. Other physiologically acceptable carriers and their formulations are known to one skilled in the art and described, for example, in Remington's Pharmaceutical Sciences, (20$^{th}$ edition), ed. A. Gennaro, 2000, Lippincott, Williams & Wilkins, Philadelphia, Pa.

By "proliferation" is meant the expansion of a population of cells by the continuous division of single cells into two identical daughter cells.

By "purified" is meant separated from other components that naturally accompany it. Typically, a compound (e.g., nucleic acid) is substantially pure when it is at least 50%, by weight, free from proteins, antibodies, and naturally-occurring organic molecules with which it is naturally associated. Preferably, the compound is at least 75%, more preferably, at least 90%, and most preferably, at least 99%, by weight, pure. A substantially pure compound may be obtained by chemical synthesis, separation of the factor from natural sources, or production of the compound in a recombinant host cell that does not naturally produce the compound. Nucleic acid molecules may be purified by one skilled in the art using standard techniques such as those described by Ausubel et al. (Current Protocols in Molecular Biology, John Wiley & Sons, New York, 2000). The nucleic acid molecule is preferably at least 2, 5, or 10 times as pure as the starting material, as measured using polyacrylamide gel electrophoresis, column chromatography, optical density, HPLC analysis, or western analysis.

By "recombinase" is meant any member of a group of enzymes that can facilitate site specific recombination between defined sites, where the sites are physically separated on a single DNA molecule or where the sites reside on separate DNA molecules. The DNA sequences of the defined recombination sites are not necessarily identical. There are several subfamilies including "integrase" (including, for example, Cre and λ integrase) and "resolvase/invertase" (including, for example, ψC31 integrase, R4 integrase, and TP-901 integrase). Two preferred recombinases and their DNA recognition sequences are Cre (recombinase)-lox (recognition sequence) or flippase (FLP) (recombinase)-Frt (recognition sequence). (See Fukushige et al., Proc. Natl. Acad. Sci. USA 89:7905-7909 (1992); O'Gorman, et al., Science 251:1351-1335 (1991); Sauer et al., Proc. Natl. Acad. Sci. USA 85:5166-70 (1988); Sauer et al., Nuc. Acids Res. 17:147-161 (1989); Sauer et al., New Biol. 2:441-49 (1990); and Sauer, Curr. Opin. Biotechnol. 5:521-7 (1994)). Desirably, recombinase expression in the cell is "transient." By "transient expression" is meant expression that diminishes over a relatively brief time span. Transient expression can be achieved by introduction of the recombinase as a purified polypeptide, for example, using liposomes, coated particles, or microinjection. Transient expression can also be achieved by introduction of a nucleic acid sequence encoding the recombinase enzyme operably linked to a promoter in an expression vector that is then introduced into the cell. Expression of the recombinase can also be regulated in other ways, for example, by placing the expression of the recombinase under the control of a regulatable promoter (i.e., a promoter whose expression can be selectively induced or repressed). It is generally preferred that the recombinase be present for only such time as is necessary for removal of the transgene sequences from the cell.

A "recombinase recognition sequence" refers to any DNA sequence recognized by a specific recombinase protein. Examples include the loxP site, which consists of two 13-bp inverted repeats flanking an 8-bp nonpalindromic core region and is recognized by Cre recombinase and the 34-bp FRT site recognized by FLP recombinase. Variants of the wild type recognition sequences are included herein. Variants can be identified by their ability to be recognized by the appropriate recombinase, as described below.

By "syntenic" is meant a corresponding gene or chromosome region occurring in the same order on a chromosome of a different species. Syntenic genes or chromosome regions are not necessarily highly homologous particularly if the conserved elements are noncoding. For example, the syntenic portion of the mouse X-inactivation center is found at human Xq13.

By "teratoma" is meant a tumor composed of tissues from the three embryonic germ layers, usually found in ovary and testis. A teratoma is generally produced experimentally in animals by injecting pluripotent stem cells and is used to determine the ability of the stem cell to differentiate into various types of tissues.

By "Tsix transgene" is meant a nucleic acid fragment substantially identical to a mammalian Tsix sequence, or any fragment thereof, that is introduced into a cell by artificial means. The transgene may or may not be integrated into the cell chromosome and may or may not be expressed. The transgene may or may not be episomal. Non-limiting examples of preferred Tsix transgene sequences include nucleic acid sequences at least substantially identical to the full-length mouse Tsix gene (FIG. 5, SEQ ID NO: 6), or fragments thereof, and nucleic acids at least substantially identical to fragments of the mouse Tsix gene such as pCC3 (SEQ ID NO: 9), p3.7 (SEQ ID NO: 10), DxPas34 (SEQ ID NO: 12), the 34 bp repeat of DxPas34 (SEQ ID NO: 13), the 68 bp repeat of DxPas34 (SEQ ID NO: 14), ns25 (SEQ ID NO: 21), ns41 (SEQ ID NO: 22), ns82 (SEQ ID NO: 23), mouse repeat A1 (SEQ ID NO: 28), mouse repeat A2 (SEQ ID NO: 29), mouse repeat B (SEQ ID NO: 30), rat repeat A (SEQ ID NO: 31), and rat repeat B (SEQ ID NO: 32). Another preferred Tsix transgene sequence includes at least 2 copies of the 34 bp or 68 bp DxPas34 repeat (SEQ ID NOs: 13 or 14, respectively), as well as at least 3 copies, at least 4 copies, and at least 5 copies or more. These preferred fragments are diagrammed in FIGS. 1, 2, and 3A and the sequences are provided in FIGS. 3B, 4, 5, and 10B. Additional non-limiting examples of preferred Tsix transgene sequences include nucleic acid sequences substantially identical to the full-length human Tsix gene (SEQ ID NO: 35), the human repeat A (SEQ ID NO: 40), or any fragments thereof, and nucleic acid sequences substantially identical to any mammalian (e.g., human, primate, bovine, ovine, feline, and canine) homologues, orthologues, paralogues, species variants, or syntenic variants of the mouse Tsix sequence (SEQ ID NO: 6), or fragments thereof. Species variations include polymorphisms in Xite and Tsix that occur between strains of mice including, but not limited to, C57BL/6, 129. and CAST/Ei mice. As indicated above for SEQ ID NOs: 13 and 14, it should be noted that for any of the fragments, particularly the smaller fragments such as SEQ ID NOs: 28, 29, 30, 31, 32, and 40, the transgene can include multiple copies of the sequences, for example, in tandem array (e.g., at least 2 copies, at least 3 copies, at least 4 copies, and at least 5 copies or more).

By "Xite transgene" is meant a nucleic acid fragment substantially identical to a mammalian Xite sequence, or any fragment thereof, that is introduced into a cell by artificial means. The transgene may or may not be integrated into the cell chromosome and may or may not be expressed. The transgene may or may not be episomal. Non-limiting examples of preferred Xite transgene sequences include nucleic acid sequences at least substantially identical to the full-length mouse Xite gene (FIG. 7, SEQ ID NO: 15), or fragments thereof, and nucleic acids at least substantially identical to fragments of the mouse Xite gene such as pXite (SEQ ID NO: 16), Xite Enhancer (SEQ ID NO: 17), ns 130 (SEQ ID NO: 24), ns135 (SEQ ID NO: 25), ns155 (SEQ ID NO: 26), ns132 (SEQ ID NO: 27). These preferred fragments are diagrammed in FIGS. 1, 2, and 3A and the sequences are provided in FIGS. 3B, 4, and 7. Additional non-limiting examples of preferred Xite transgene sequences include nucleic acid sequences substantially identical to the human Xite gene (SEQ ID NO: 38), or fragments thereof, and nucleic acid sequences substantially identical to any mammalian (e.g., human, primate, bovine, ovine, feline, and canine) homologues, orthologues, paralogues, species variants, or syntenic variants of the mouse Xite sequence (SEQ ID NO: 15), or fragments thereof. Species variations include polymorphisms in Xite and Tsix that occur between strains of mice including, but not limited to, C57BL/6, 129, and CAST/Ei mice.

By "Tsix/Xite transgene" is meant a nucleic acid substantially identical to a mammalian Tsix, Xite, or combined or intervening Tsix/Xite sequence, or any fragment thereof, that is introduced into a cell by artificial means. The transgene may or may not be integrated into the cell chromosome and may or may not be expressed. The transgene may or may not be episomal. Sequences that include a region that spans all or a portion of both genes or the intervening region between the two genes are known as Tsix/Xite transgene and can also be used in the methods of the invention. Non-limiting examples of preferred Tsix/Xite transgenes include nucleic acid sequences substantially identical to the critical region spanning both genes in the mouse, such as pSxn (SEQ ID NO: 4), pCC4 (SEQ ID NO: 11), and the bipartite enhancer (SEQ ID NO: 19). These preferred fragments are diagrammed in FIGS. 1 and 3A and the sequences are provided in FIGS. 3B and 4. Additional non-limiting examples of preferred Tsix/Xite transgene sequences include nucleic acid sequences substantially identical to the critical region spanning both genes in the human chromosome, such as pSxn human (SEQ ID NO: 37), or fragments thereof, and nucleic acid sequences substantially identical to any mammalian (e.g., human, primate, bovine, ovine, feline, and canine) homologues, orthologues, paralogues, species variants, or syntenic variants of the critical region spanning both Tsix and Xite genes in the mouse, or fragments thereof. Species variations include polymorphisms in Xite and Tsix that occur between strains of mice including, but not limited to, C57BL/6, 129, and CAST/Ei mice.

By "Xic transgene" is meant a nucleic acid molecule substantially identical to a mammalian Xic region that is introduced into a cell by artificial means. The transgene may or may not be integrated into the cell chromosome and may or may not be expressed. The transgene may or may not be episomal. Preferred Xic transgenes include the full-length mouse Xic (SEQ ID NO: 1), nucleotides 80,000 to 180,000 of GenBank Accession No. AJ421479 (SEQ ID NO: 47). Each of the mouse transgenes described herein is found within this 100 kB fragment of AJ421749. For example, mouse Xist is found from nt 106,296 to nt 129,140, the mouse Tsix/Xite sequences are found within nt 157,186 to nt 104,000, and mouse Tsx sequence is found from nt 174,041 to nt 163,932. Another fragment within the mouse Xic is Jpx/Enox, found from nt 95,894 to nt 86,564 of AJ421-479. Preferred Xic fragments include πJL2 (SEQ ID NO: 2) and πJL3 (SEQ ID NO: 3). Additional non-limiting examples of preferred Xic transgene sequences include nucleic acid sequences substantially identical to the human Xic (SEQ ID NO: 39), or fragments thereof, and nucleic acid sequences substantially identical to any mammalian (e.g., human, primate, bovine, ovine, feline, and canine) homologues, orthologues, paralogues, species variants, or syntenic variants of the mouse Xic (SEQ ID NO: 1), or fragments thereof.

By "Xic flanking region transgene" is meant a nucleic acid molecule substantially identical to sequences surrounding, and in some cases overlapping, with the mammalian Xic region, that is introduced into a cell by artificial means. The sequences set forth in GenBank Accession numbers: AJ211478, AJ421479, and AJ421489 (SEQ ID NOs: 46-48) include the 100 kB Xic of SEQ ID NO: 1 as well as the entire mouse Xic flanking region. These three entries make up a contiguous sequence and the Xic flanking region transgene can include any part of this region. While the Xic flanking region is intended to include sequences surrounding the 100 kB of SEQ ID NO: 1, the Xic flanking region transgene can also include sequences that overlap between the Xic and the flanking region. Exemplary preferred Xic flanking region transgenes include sequences 350 kb upstream of Xist (SEQ ID NOs: 49 and 50) that include, but are not limited to, genes Xpct, Cnbp2, Ftx, Jpx/Enox, or any fragments thereof. This region is associated with a hotspot of H3-K9 and H3-K27 methylation that may contain sequences responsible for pairing, counting and/or choice. Additional exemplary Xic flanking region transgenes include the 286 kB sequences upstream of Xite (e.g., SEQ ID NOs: 51 and 52), or any fragments thereof. This region includes (but is not limited to) genes Tsx, Chic1, Cdx4, and NapIL2. (See Augui et al., *Science* 318: 1632-1636 (2007) for Xic flanking regions.)

By "Xist transgene" is meant a nucleic acid substantially identical to a mammalian Xist sequence, or any fragment thereof, that is introduced into a cell by artificial means. The transgene may or may not be integrated into the cell chromosome and may or may not be expressed. The transgene may or may not be episomal. Non-limiting examples of preferred Xist transgene sequences include nucleic acid sequences at least substantially identical to the full-length mouse Xist gene (FIG. 6, SEQ ID NO: 20), or fragments thereof, and nucleic acids at least substantially identical to fragments of the mouse Xist gene such as pXist 3' (SEQ ID NO: 7) and pXist 5' (SEQ ID NO: 8). These preferred fragments are diagrammed in FIG. 1 and the sequences are provided in FIG. 6. Additional non-limiting examples of preferred Xist transgene sequences include nucleic acid sequences substantially identical to the human Xist gene (SEQ ID NO: 35), or fragments thereof, and nucleic acid sequences substantially identical to any mammalian (e.g., human, primate, bovine, ovine, feline, and canine) homologues, orthologues, paralogues, species variants, or syntenic variants of the mouse Xist sequence (SEQ ID NO: 20), or fragments thereof. Species variations include polymorphisms in Xist that occur between strains of mice including, but not limited to, C57BL/6, 129, and CAST/Ei mice.

Stem cell differentiation is an irreversible process and commitment to the differentiation pathway prevents or greatly reduces the clinician's or investigator's ability to modify the stem cell in a way that is therapeutically useful. The enormous therapeutic potential of stem cells relies on the ability to control stem cell differentiation. Thus, there is a need for efficient methods for blocking or delaying differentiation in a stem cell in a manner that is reversible. The present invention provides such novel methods for controlling stem cell differentiation and allows for both the inhibition and induction of stem cell differentiation in a controlled manner. The present invention is based on the discovery that disruptions in the XCI process, either by an excess or a depletion of Xic, Tsix, Xite, or Xic flanking region sequences can block differentiation. In the present methods, disruptions in the XCI process are achieved through the use of transgenes or small RNAs derived from Xic, Tsix, Xite, or Xic flanking region sequences, or fragments thereof, that are introduced into stem cells and prevent the stem cells from undergoing X chromosome inactivation and from differentiating in culture. These novel methods for manipulating stem cell differentiation allow the clinician or researcher to maintain the stem cells in the undifferentiated state for a sufficient time to modify the cells as desired (e.g., by introducing therapeutic genes) for therapeutic or research purposes, without having the limitations of cell or cell product contamination or inefficient inhibition of differentiation. The methods also allow the clinician to readily remove the block to differentiation, again in an efficient manner and free from contamination issues, so that the cells can be administered to a subject. The invention also features cells produced by the methods of controlling or delaying differentiation that can self-renew indefinitely in culture and are useful for therapeutic purposes such as regenerative medicine and gene therapy.

Other features and advantages of the invention will be apparent from the following Detailed Description, the drawings, and the claims.

BRIEF DESCRIPTION OF THE DRAWINGS

FIGS. 3A and 3B-1 to 3B-61 are a diagram and corresponding nucleic acid sequence of the pSxN transgene. FIG. 3A is a diagram of the pSxN6 (also referred to as pSxN) transgene showing a set of preferred transgenes for blocking stem cell differentiation. This region includes the 5' end of Tsix and Xite and contains elements critical for counting (numerator), cell differentiation, imprinting, choice, and mutual exclusion of X's. FIGS. 3B-1 to 3B-61 are an annotated sequence map of the pSxN transgene (SEQ ID NO: 4). The sequence map is annotated to show restriction sites and the specific location of each of the transgenes identified in FIG. 3A.

FIG. 4 is an annotated nucleic acid sequence showing the 34 and 68 base pair repeats (SEQ ID NO: 13 and 14, respectively) of the DxPas34 transgene (SEQ ID NO: 12). Each line of sequence represents a 34 base pair repeat. These repeats are located between nt 5074-6630 of SEQ ID NO: 4 (FIG. 3B). Note that the 34 and 68 bp repeats are not exact repeats but vary slightly from one to the next.

FIGS. 5-1 to 5-18 are a nucleic acid sequence showing the mouse Tsix RNA sequence (unspliced form; SEQ ID NO: 6).

FIGS. 6-1 to 6-10 are a nucleic acid sequence showing the full-length mouse Xist RNA (unspliced form; SEQ ID NO: 20).

FIGS. 7-1 to 7-9 are a nucleic acid sequence showing the mouse Xite region (SEQ ID NO: 15). This sequence is oriented in the same direction as the annotated sequence of pSxn (FIGS. 3B-1 to 3B-61). Xite initiates in multiple locations within two clusters of start sites. The first cluster is around nt 6995-5773 (where there is the 1.2 kb enhancer). The second cluster is around nt 13000-12500. Note that all transcripts proceed in the antisense orientation (e.g., from nt 6995 to nt 1). Also note that Xite does not "end." It just diminishes when it reaches Tsix. Also note that the second of the two start clusters is outside of the pSxn critical region but is still part of Xite.

FIG. 8 is a map of the Xic and P1 transgenes covering various regions of the Xic. The transgene sequences are: πJL2, an 80 kb P1 plasmid containing Xist and 30 kb upstream and downstream sequence (Lee et al., Proc. Natl. Acad. Sci. U.S.A. (1999), supra); πJL3, an 80 kb P1 plasmid containing Xist and 60 kb of sequence downstream (Lee et al., Proc. Natl. Acad. Sci. U.S.A. (1999), supra); and pSx7, the BssHII-NotI fragment of πJL1.

FIG. 9 is a map of the Xic and finer transgenes. The sequences carried by each transgene are: pSxn, a 19.5 kb RsrII-NotI fragment of λJL1 (SEQ ID NO: 4); p3.7, the 3.7 kb MluI-SacI sequence deleted from Tsix$^{\Delta CpG}$ (SEQ ID NO: 10; Lee et al., Cell (1999) supra); pCC3, a 4.3 kb BamHI fragment downstream of the Tsix promoter (SEQ ID NO: 9); pCC4, a 5.9 kb BamHI fragment upstream of and including the Tsix promoter (SEQ ID NO: 11); pXite, a 5.6 kb fragment spanning DHS1-4 of Xite (Ogawa et al., supra); pXist5', a 4.8 kb XbaI-XhoI fragment from the Xist promoter (SEQ ID NO: 8); pXist3', a 4.9 kb PstI fragment from Xist exon 7 (SEQ ID NO: 7); and pTsx, by 41,347-52,236 of Genbank X99946 from the Tsx locus (SEQ ID NO: 18).

FIGS. 10 A-E show DXPas34 is conserved and bears resemblance to transposable elements (TEs). FIG. 10A is a dot-plot of mouse (x-axis, 138,745-141,000 of AJ421-479) vs. rat (y-axis, 51,001-53,300 of N_WO48043) sequences at DXPas34. Positions of different repeat clusters are as shown. FIG. 10B shows the consensus repeat sequences as determined for each species. Human repeat A, SEQ ID NO: 40; mouse repeat A1, SEQ ID NO: 28; mouse repeat A2, SEQ ID NO: 29; mouse repeat B, SEQ ID NO: 30; rat repeat A, SEQ ID NO: 31; rat repeat B, SEQ ID NO: 32. FIG. 10C shows a dot-plot analysis of mouse (x-axis, bp 134,001-141,000 of AJ421479) vs. human (y-axis, by 11,328,000-11,352,000 of NT_011669). Regions 2 and 3 are as marked (Lee et al., Cell 99:47-57 (1999)). 14 kb insertion in human sequence, along with region containing A repeats (grey box), is marked on y-axis. FIG. 10D shows a schematic of human A-repeat region showing positions of ERV/LTRs and SINEs (light and dark grey boxes) and A-repeat units (black triangles). Sequence of a representative ERV/LTR (bp 11345000-11348700 of NT_011669; SEQ ID NO: 43) is shown, with A-repeats boxed. FIG. 10E shows the human repeat A (SEQ ID NO: 40) perfectly matches the corresponding region of the human HERVL repeat (SEQ ID NO: 44). Mouse DXPas34 (A1 motif) (SEQ ID NO: 28) also shows excellent alignment with human HERVL (4 mismatches out of 27 bp) and mouse MERVL/RatERVL (5 mismatches) (SEQ ID NO: 45).

DETAILED DESCRIPTION

Figure 1:
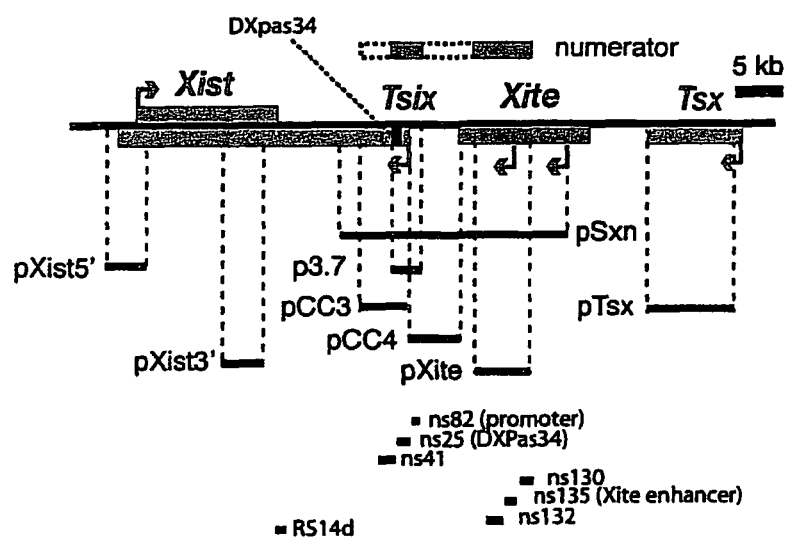
FIG. 1 is a diagram of the Xic region showing a set of preferred transgenes for blocking stem cell differentiation.

Stem cells have enormous clinical potential because of their ability to self-renew indefinitely and to differentiate into a large number of cells and tissue types. Their potential use in regenerative therapy and gene therapy is almost limitless but is dependent on the ability to control the otherwise irreversible process of differentiation.

The present invention features a method for controlling such differentiation by introducing Xic, Tsix, Xite, Tsix/Xite, or Xic flanking region sequences transgenes or fragments thereof, or small RNA derived from Xic, Tsix, Xite, Tsix/Xit, or Xic flanking regions to inhibit differentiation. This allows sufficient time to manipulate the stem cells as desired for therapeutic or research purposes. Subsequent removal of the transgene allows for the induction of differentiation of the stem cells into the desired cell or tissue type, and administration to a patient.

Transgenes

The present invention is based on the discovery that the introduction of a transgene having Xic, Tsix, Xite, Tsix/Xite sequences, Xic flanking region sequences, or fragments thereof, into the stem cell inhibits differentiation. Transgenes useful in the invention can include any Xic, Tsix, Xite, or Xic flanking region nucleic acid sequences or Tsix/Xite nucleic acid sequences having a part or all of both Tsix and Xite sequences.

Tsix and Xite are non-coding cis-acting genes found in the master regulatory region called the X-inactivation center (Xic). This region contains a number of unusual noncoding genes, including Xist, Tsix, and Xite, that work together to ensure that XCI takes place only in the XX female, only on one chromosome, and in a developmentally specific manner. Each of these genes makes RNA instead of protein. Xist is made only from the future inactive X and makes a 20 kb RNA that "coats" the inactive X, thereby initiating the process of gene silencing. Tsix is the antisense regulator of Xist and acts by preventing the spread of Xist RNA along the X-chromosome. Thus, Tsix designates the future active X. Xite works together with Tsix to ensure the active state of the X. Xite makes a series of intergenic RNAs and assumes special chromatin conformation. Its action enhances the expression of antisense Tsix, thereby synergizing with Tsix to designate the future active X. In addition, Tsix and Xite function together to regulate the counting and choice aspects of XCI through X-X pairing as described herein and in PCT publication number WO 2007/053207.

In addition, in the nucleic acid sequences flanking the Xic, there are many other noncoding RNA genes, including Ftx, Jpx/Enox, Tsx, and Chic1. The 350 kb region upstream of Xist has been associated with a hotspot for histone H3 lysine 9 hypermethylation and H3 lysine 27 hypermethylation. These marks and/or their associated regions may be involved with X-X pairing and therefore regulate counting, choice, and cell differentiation.

Transgenes having Xic, Tsix, Xite, Tsix/Xite, Xic flanking region sequences, or fragments or combinations thereof, are useful in the methods of the invention to delay or control differentiation. It should be noted that although preferred fragments within the Xic, Tsix, Xite, Tsix/Xite, or Xic flanking region sequences are specified, any nucleic acid sequence within this region is useful in the methods of the invention. The data presented in PCT publication number WO 2007/053207, herein incorporated by reference in its entirety, identifying the functional redundancy of this region with respect to blocking X-X pairing, counting and cell differentiation supports the use of any fragment from this region. For example, any sequence from this region that can inhibit X-X pairing (e.g., by inducing de novo X-transgene pairing) can be used to block differentiation.

Non-limiting examples of preferred Xic transgene sequences include the mouse Xic (SEQ ID NO: 1) or the human syntenic equivalent (SEQ ID NO: 39), πJL2 (SEQ ID NO: 2), and πJL3 (SEQ ID NO: 3).

Non-limiting examples of preferred Xic flanking region transgene sequences include nucleic acid regions upstream and downstream of the Xist and Xite sequences found in the mouse Xic sequences of SEQ ID NO: 1. These Xic flanking region transgenes include any nucleic acid sequence that is substantially identical to SEQ ID NOs: 46-48 (three contiguous sequences that encompass the mouse Xic and the Xic flanking regions), 49-50 (sequences flanking the Xic and upstream of Xist) or 51-52 (sequences flanking the Xic and upstream of Xite), or any fragment thereof.

Non-limiting examples of preferred Tsix transgene sequences include nucleic acid sequences at least substantially identical to the full-length mouse Tsix gene (SEQ ID NO: 6), or fragments thereof, and nucleic acids at least substantially identical to fragments of the mouse Tsix gene such as the highly conserved region (SEQ ID NO: 5), pCC3 (SEQ ID NO: 9), p3.7 (SEQ ID NO: 10), DxPas34 (SEQ ID NO: 12), the 34 bp repeat of DxPas34 (SEQ ID NO: 13), the 68 bp repeat of DxPas34 (SEQ ID NO: 14), ns25 (SEQ ID NO: 21), ns41 (SEQ ID NO: 22), ns82 (SEQ ID NO: 23), mouse repeat A1 (SEQ ID NO: 28), mouse repeat A2 (SEQ ID NO: 29), mouse repeat B (SEQ ID NO: 30), rat repeat A (SEQ ID NO: 31), and rat repeat B (SEQ ID NO: 32). Another preferred Tsix transgene sequence includes at least 2 copies of the 34 bp or 68 bp DxPas34 repeat (SEQ ID NOs: 13 or 14, respectively), as well as at least 3 copies, at least 4 copies, and at least 5 copies or more. Additional preferred Tsix transgene sequences include nucleic acid sequences at least substantially identical to the human syntenic equivalents: the full-length human Tsix gene (SEQ ID NO: 36), the human repeat A (SEQ ID NO: 40), or any fragments thereof, and nucleic acid sequences substantially identical to any mammalian (e.g., human, primate, bovine, ovine, feline, and canine) homologues, orthologues, paralogues, species variants, or syntenic variants of the mouse Tsix sequence (SEQ ID NO: 6), or fragments thereof.

As indicated above for SEQ ID NOs: 13 and 14, it should be noted that for any of the fragments, particularly the smaller fragments such as SEQ ID NOs: 28, 29, 30, 31, 32, and 40, the transgene can include multiple copies of the sequences, for example, in tandem array (e.g., at least 2 copies, at least 3 copies, at least 4 copies, and at least 5 copies or more). The mouse repeat A1 (SEQ ID NO: 28), mouse repeat A2 (SEQ ID NO: 29), mouse repeat B (SEQ ID NO: 30), rat repeat A (SEQ ID NO: 31), rat repeat B (SEQ ID NO: 32), and human repeat A (SEQ ID NO: 40) are all part of the DXPas34 region and include the canonical sequences required for binding the transcription factor, CTCF. These small repeat units of DxPas and any ERV derived multimer of the canonical sequences provided in FIG. 10B are therefore included as preferred Tsix transgene sequences that are useful in the methods of the invention.

Non-limiting examples of preferred Xite transgene sequences include nucleic acid sequences at least substantially identical to the full-length mouse Xite gene (SEQ ID NO: 15), or fragments thereof, and nucleic acids at least substantially identical to fragments of the mouse Xite gene such as pXite (SEQ ID NO: 16), Xite Enhancer (SEQ ID NO: 17), ns130 (SEQ ID NO: 24), ns135 (SEQ ID NO: 25), ns155 (SEQ ID NO: 26), ns132 (SEQ ID NO: 27). Additional non-limiting examples of preferred Xite transgene sequences include nucleic acid sequences substantially identical to the human Xite gene (SEQ ID NO: 38), or fragments thereof, and nucleic acid sequences substantially identical to any mammalian (e.g., human, primate, bovine, ovine, feline, and canine) homologues, orthologues, paralogues, species variants, or syntenic variants of the mouse Xite sequence (SEQ ID NO: 15), or fragments thereof.

Sequences that include a region that spans all or a portion of both genes or the intervening region between the two genes are known as Tsix/Xite transgene and can also be used as transgenes in the methods of the invention. Non-limiting examples include a nucleic acid having the entire critical region spanning both genes of the mouse chromosome, pSxn (SEQ ID NO: 4), pCC4 (SEQ ID NO: 11), and the bipartite enhancer (SEQ ID NO: 19). Additional preferred Tsix/Xite transgene sequences include nucleic acid sequence substantially identical to the intervening region between the human syntenic equivalents of Tsix (SEQ ID NO: 36) and Xite (SEQ ID NO: 38). One example of a human Tsix/Xite transgene sequence is pSxN human (SEQ ID NO: 37).

The preferred fragments are shown in Tables 1 and 2, below. Note that because the transgenes and fragments are non-coding regions, the exact start and end of the sequence is of little importance. Therefore, for all fragments, the size and nucleotide sequences are approximate values and can be altered by 1, 2, 5, 10, 20, 30, 40, 50, 100, 150, 200, 250, 500, 750, 1000 or more nucleotides.

TABLE 1

Mouse and Rat Sequences.

Figure 2:
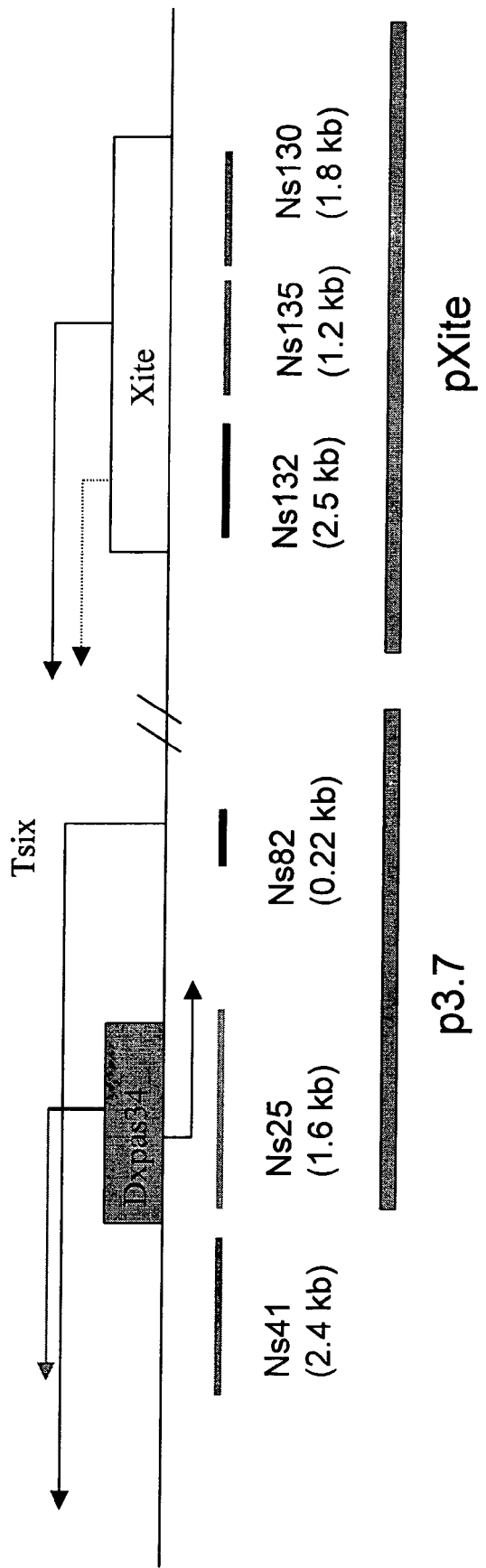
FIG. 2 is a diagram of a subset of the Xic region showing the Tsix/Xite junction in greater detail. Additional preferred transgenes are indicated.
Figure 3A:
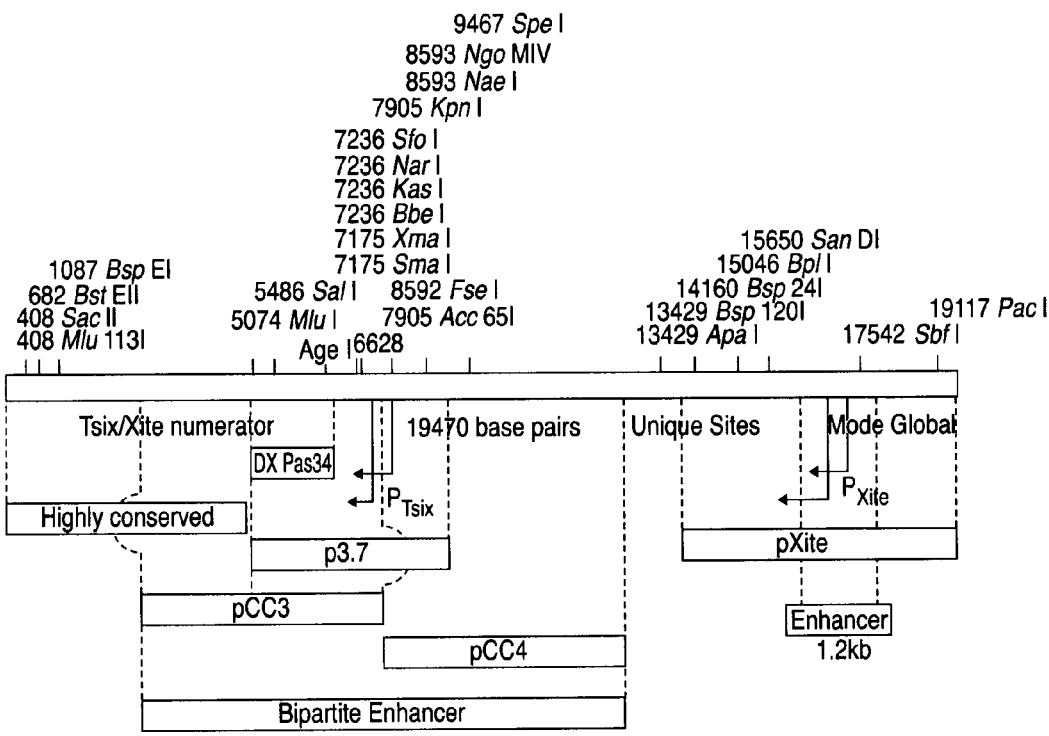
Figures 3, 3B, 4, 5, 6, 7, 8, 9, 10, 11, 12, 13, 14, 15, 16, 17, 18, 19, 20, 21, 22, 23, 24, 25, 26:
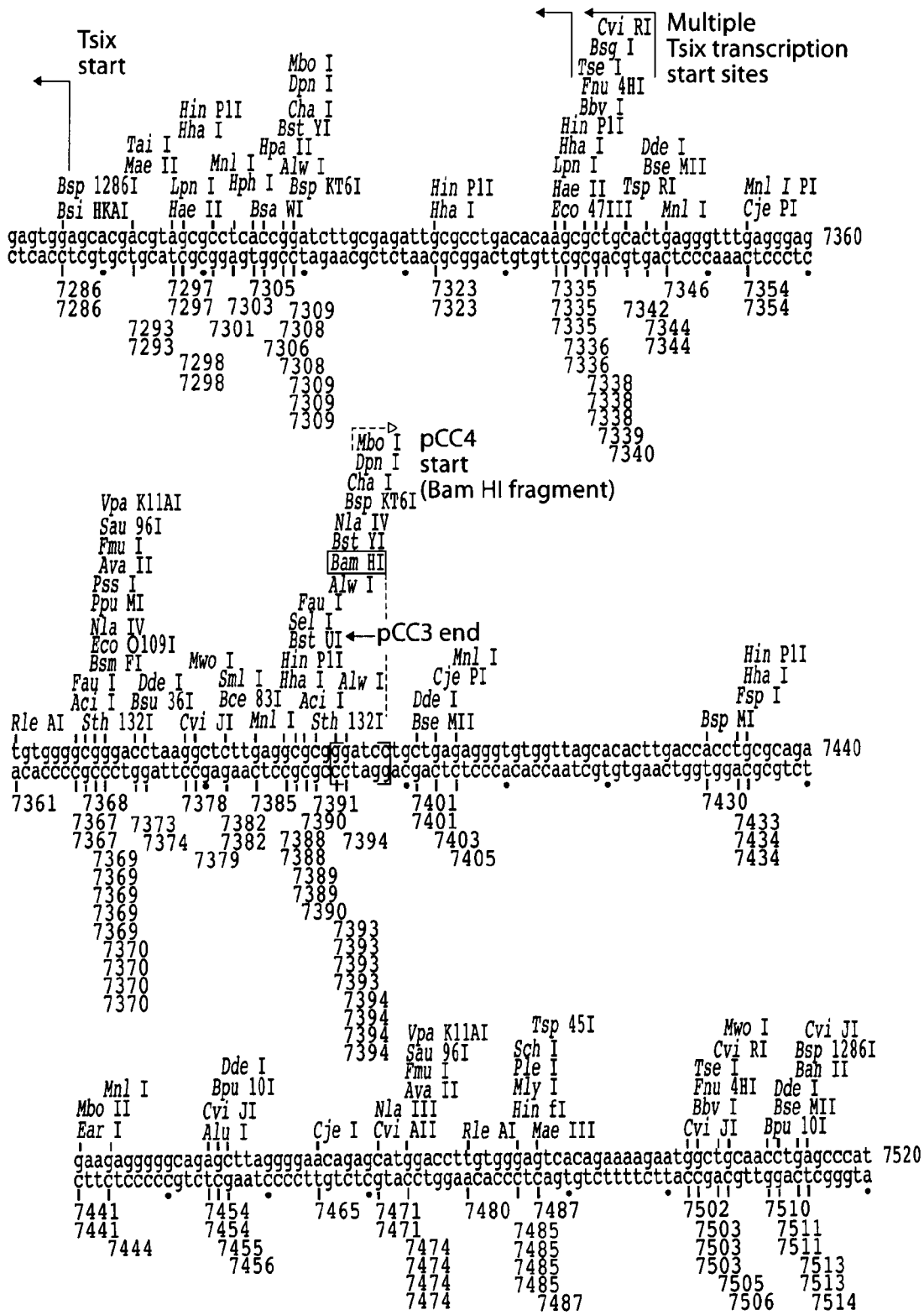
Figure 8:
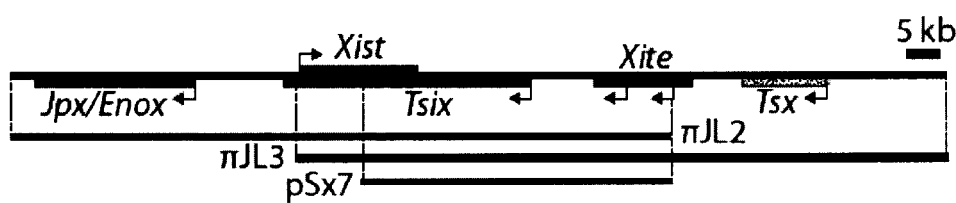
Figure 9:
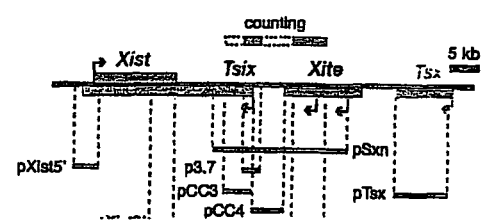
Figure 10:
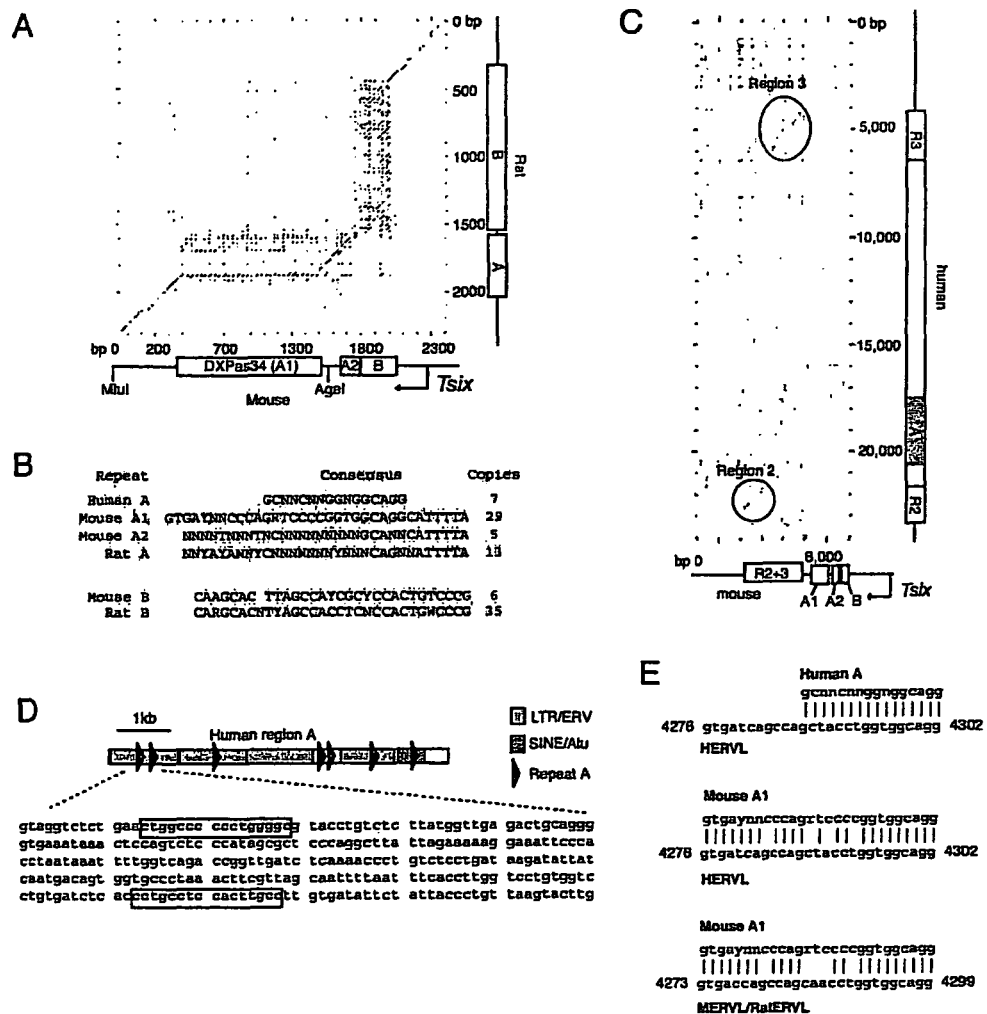

| SEQ ID NO | Name | Length (approx.) | Nucleotide Sequence | Reference Figure |
|---|---|---|---|---|
| 1 | Xic | 100 kb | nt 80,000 to 180,000 of GenBank AJ421479 | FIG. 1 |
| 2 | πJL2 | 80 kB | Xist + 30 kB up and downstream | FIG. 8 |
| 3 | πJL3 | 80 kB | Xist + 60 kB downstream | FIG. 8 |
| 4 | pSxN | 19.5 kB | see FIGS. 3A and 3B | FIGS. 1, 3A and 3B |
| 5 | Highly conserved | 5 kB | nt 1-5074 of SEQ ID NO: 4 (see FIG. 3B) | FIG. 3A, 3B |
| 6 | Full length Tsix | 40 kB | FIG. 5, nt 157,186-104,000 of AJ421479 | FIG. 5 |
| 7 | pXist 3' | 4.9 kB | Not shown | FIG. 1 |
| 8 | pXist 5' | 4.8 kB | Not shown | FIG. 1 |
| 9 | pCC3 | 4.3 kB | nt 3079-7395 of SEQ ID NO: 4 (see FIG. 3B) | FIGS. 1, 3A and 3B |
| 10 | p3.7 | 3.7 kB | nt 5074-8768 of SEQ ID NO: 4 (see FIG. 3B) | FIGS. 1, 2, 3A and 3B |
| 11 | pCC4 | 5.9 kB | nt 7395-13274 of SEQ ID NO: 4 (see FIG. 3B) | FIGS. 1, 3A and 3B |
| 12 | DxPas34 | 1.5 kB | nt 5073-6635 of SEQ ID NO: 4 (see FIG. 3B) | FIGS. 1, 3A and 3B |
| 13 | 34 bp repeat | 34 | Throughout nt 5073-6635 of SEQ ID NO: 4 | FIG. 3B, 4 |
| 14 | 68 bp repeat | 68 | Throughout nt 5073-6635 of SEQ ID NO: 4 | FIGS. 3B, 4 |
| 15 | Full length Xite | 20 kB | FIG. 7, nt 157,186-104,000 of AJ421479 | FIG. 7 |
| 16 | pXite | 5.6 kB | nt 13887-19467 of SEQ ID NO: 4 (see FIG. 3B) | FIGS. 1, 2, 3A and 3B |
| 17 | Xite Enhancer | 1.2 kB | nt 16360-17582 of SEQ ID NO: 4 (see FIG. 3B) | FIGS. 1, 3A and 3B |
| 18 | pTsx | 10.8 kB | nt 41,347-52,236 of GenBank X99946 (SEQ ID NO: 33) | FIG. 1 |
| 19 | Bipartite Enhancer | 10.2 kB | nt 3079-12274 of SEQ ID NO: 4 (see FIG. 3B) | FIG. 3A, 3B |
| 20 | Full length Xist | 23 kB | FIG. 5, nt 106,296-129,140 of AJ421479 | FIG. 6 |
| 21 | ns25 (DXPas34) | 1.6 kB | nt 5485 (SalI) to 7177 (SmaI) of SEQ ID NO: 4 (see FIG. 3B) | FIGS. 1, 2, and 3B |
| 22 | ns41 | 2.4 kB | nt 3079 (BamHI) to 5486 (SalI) of SEQ ID NO: 4 (see FIG. 3B) | FIGS. 1, 2, and 3B |
| 23 | ns82 (Tsix promoter) | 220 bp | nt 7177 (SamI) to 7398 (BamHI) of SEQ ID NO: 4 FIG.3B) | FIGS. 1, 2 and 3B |
| 24 | ns130 | 1.8 kB | nt 17580 to 19467 of SEQ ID NO: 4 (see FIG. 3B) | FIGS. 1, 2, and 3B |
| 25 | ns135 (1.2 kb Xite enhancer) | 1.2 kB | nt 16360 (StuI) to 17583 (XhoI) of SEQ ID NO: 4 (see FIG. 3B) | FIGS. 1, 2, and 3B |

TABLE 1-continued

Mouse and Rat Sequences.

| SEQ ID NO | Name | Length (approx.) | Nucleotide Sequence | Reference Figure |
|---|---|---|---|---|
| 26 | ns 155 (equivalent to ns 135) | 1.2 kb | nt 16360 (StuI) to 17583 (XhoI) of SEQ ID NO: 4 (see FIG. 3B) | FIGS. 1 and 3B |
| 27 | ns132 | 2.4 kB | nt 13883 (AvrII) to 16363 (StuI) of SEQ ID NO: 4 (see FIG. 3B) | FIGS. 1, 2, and 3B |
| 28 | Mouse repeat A1 | 34 | GTGAYNNCCCAGRTCCCCGGTGGCAGGCATTTTA | FIG. 10B |
| 29 | Mouse repeat A2 | 32 | NNNNTNNNTNCNNNNNNNNNNGCANNCATTTTA | FIG. 10B |
| 30 | Mouse repeat B | 30 | CAAGCACTTAGCCAYCGCYCCACTGTCCCG | FIG. 10B |
| 31 | Rat repeat A | 32 | NNYAYANNYCNNNNNNNYNNNCAGNNATTTTA | FIG. 10B |
| 32 | Rat repeat B | 31 | CATGCACNTYAGCCACCTCNCCACTGWCCCG | FIG. 10B |
| 46 | Sequences flanking the Xic (ustream of Xist), including Xpct and Cnbp and Ftx | 248 kb | GenBank Accession No. AJ421478 | |
| 47 | Xic plus surrouning sequences, including Ftx, Jpx/Enox, Xist, Tsix, Xite, Tsx, and Chic1 | 252 kb | GenBank Accession No. AJ421479 | |
| 48 | Sequences flanking the Xic (upstream of Xite), including Cdx4 and NapIL2 | 214 kb | GenBank Accession No. AJ421480 | |
| 49 | Part of the 350 kb H3-K9 and H3-K27 methylation hotspot, upstream of Xist; Sequences flanking the Xic (upstream of Xist), including Xpct, Cnbp2 and Ftx | 248 kb | nt 1 to 247,850 of GenBank Accession No. AJ421478 | |
| 50 | Part of the 350 kb H3-K9 and H3-K27 methylation hotspot upstream of Xist; | 80 kb | nt 1 to 80,000 of GenBank Accession No. AJ421479 | |
| 51 | Part of region upstream of Xite (segment 1) | 72 kb | nt 180,000 to 252,150 of GenBank Accession No. AJ421479 | |
| 52 | Part of region upstream of Xite (segment 2) | 214 kb | nt 1 to 214,384 of GenBank Accession No. AJ421480 | |

"N" refers to any nucleotide
"Y" refers to either pyrimidine
"R" refers to either purine
*Note that the sequences as shown in FIG. 5 and GenBank Accession No. AJ421479 hav3 a 3 kB deletion in the Zeste repeat region. This region cannot be sequenced. These coordinates are based on the sequence provided and do not include the 3 kB gap in the sequence.

TABLE 2

Human Sequences

| SEQ ID NO | Name | Length (approximate) | Nucleotide Sequence (approximate) |
|---|---|---|---|
| 35 | Xist | 32 kB | 11,390,576-11,358,483 of NT_011669 |
| 36 | Tsix | 64 kB | 11,329,000-11,393,000 of NT_011669 |
| 37 | pSxN human | 50-60 kB | 11,358,483-11,300,000 of NT_011669 |
| 38 | Xite | 13 kB | 11,320,000-11,333,000 of NT_011669 |
| 39 | Xic | 80 kB | 11,320,000-11,450,000 of NT_011669 |
| 40 | Repeat A | 16 bp | GCNNCNNGGNGGCAGG, FIG. 10B |

For any of the Xic, Tsix, Xite, Xic flanking regions, and combined Tsix/Xite transgene sequences, it will be understood that mammalian (e.g., human, mouse, primate, bovine, ovine, feline, and canine) homologues, orthologues, paralogues, species variants, or syntenic variants are also included. For example, the human syntenic region includes approximately 15 megabases of contiguous human sequence on the X chromosome (GenBank Accession Number NT_011669, SEQ ID NO: 34). These 15 megabases of sequence include the human Xic region as well as additional Xic flanking sequences on both ends of the Xic region. The syntenic equivalent of Xist is found at approximately nucleotides 11,390,576 to 11,358,483 (SEQ ID NO: 35) of GenBank Accession Number NT_011669. The critical region including Tsix and Xite in the human sequence is predicted to be from approximately nucleotides 11,358,483 to nucleotide 11,300,000 (pSxN, human, SEQ ID NO: 37) of GenBank Accession Number NT_011669. The syntenic equivalent of Tsix (SEQ ID NO: 36) is found at approximately nucleotides. 11,329,000-11,393,000 and the syntenic equivalent of Xite (SEQ ID NO: 38) is found at approximately nucleotides 11,320,000 to 11,333,000 of NT_011669. Transgenes that are useful in the methods of the invention can be identified using assays for the ability of the transgene to block X chromosome inactivation or differentiation. Such assays are known in the art and examples are described herein and in PCT publication number WO 2007/053207.

RNA Interference (RNAi)

The present invention is based on the discovery that disruptions in the XCI process can block differentiation. One method for interfering with XCI involves the use of small RNA molecules, such as siRNA, directed to Xic, Tsix, Xite, Xist, or Xic flanking regions that are introduced into stem cells and prevent the stem cells from undergoing X chromosome inactivation and from differentiating in culture. The use of such small RNA molecules circumvents the need for removal of the transgene because the small RNA molecules have a limited half-life and will naturally degrade.

RNAi is a form of post-transcriptional gene silencing initiated by the introduction of double-stranded RNA (dsRNA). Short 15 to 32 nucleotide double-stranded RNAs, known generally as "siRNAs," "small RNAs," or "microRNAs" are effective at down-regulating gene expression in nematodes (Zamore et al., *Cell* 101: 25-33) and in mammalian tissue culture cell lines (Elbashir et al., *Nature* 411:494-498, 2001, hereby incorporated by reference). The further therapeutic effectiveness of this approach in mammals was demonstrated in vivo by McCaffrey et al. (*Nature* 418:38-39. 2002). The small RNAs are at least 15 nucleotides, preferably, 17, 18, 19, 20, 21, 22, 23, 24, 25, 26, 27, 28, 29, 30, 31, 32, 33, 34, 35, nucleotides in length and even up to 50 or 100 nucleotides in length (inclusive of all integers in between). Such small RNAs that are substantially identical to or complementary to any region of Xic, Tsix, Xite, Xist, or Xic flanking regions are included in the invention based on the discovery that Tsix, Xite, and also Xist elements are transcribed and portions of these regions exhibit bidirectional transcription, with the potential therefore for the formation of double-stranded RNAs which may then be subject to the RNAi pathway. In fact, small non-coding RNAs (ncRNAs) ranging from less than 25 nt to approximately 100 nt in size, corresponding to regions of Xite have been identified from both the sense and antisense strands (see FIG. 36 of PCT publication number WO 2007/053207. Furthermore, transcription or the ncRNA products of Xic, Tsix Xite, or Tsix/Xite, or both, have been shown to be required for pairing during XCI.

Therefore, the invention includes any small RNA substantially identical to at least 15 nucleotides, preferably, 17, 18, 19, 20, 21, 22, 23, 24, 25, 26, 27, 28, 29, 30, 31, 32, 33, 34, or 35, nucleotides in length and even up to 50 or 100 nucleotides in length (inclusive of all integers in between) of any region of Xic, Tsix, Xite, Xist, or Xic flanking region, preferably the regions described herein and shown in Tables 1 and 2. The invention also includes the use of such small RNA molecules to block differentiation. It should be noted that, as described below, longer dsRNA fragments can be used that are processed into such small RNAs. Useful small RNAs can be identified by their ability to block differentiation, block pairing, or block XCI using the methods described herein or in PCT publication number WO 2007/053207. Small RNAs can also include short hairpin RNAs in which both strands of an siRNA duplex are included within a single RNA molecule.

The specific requirements and modifications of small RNA are known in the art and are described, for example, in PCT Publication No. WO01/75164, and U.S. Application Publication Numbers 20060134787, 20050153918, 20050058982, 20050037988, and 20040203145, the relevant portions of which are herein incorporated by reference. In particular embodiments, siRNAs can be synthesized or generated by processing longer double-stranded RNAs, for example, in the presence of the enzyme dicer under conditions in which the dsRNA is processed to RNA molecules of about 17 to about 26 nucleotides. siRNAs can also be generated by expression of the corresponding DNA fragment (e.g., a hairpin DNA construct). Generally, the siRNA has a characteristic 2- to 3-nucleotide 3' overhanging ends, preferably these are (2'-deoxy) thymidine or uracil. The siRNAs typically comprise a 3' hydroxyl group. In some embodiments, single stranded siRNAs or blunt ended dsRNA are used. In order to further enhance the stability of the RNA, the 3' overhangs are stabilized against degradation. In one embodiment, the RNA is stabilized by including purine nucleotides, such as adenosine or guanosine. Alternatively, substitution of pyrimidine nucleotides by modified analogs e.g. substitution of uridine 2-nucleotide overhangs by (2'-deoxy)thymide is tolerated and does not affect the efficiency of RNAi. The absence of a 2' hydroxyl group significantly enhances the nuclease resistance of the overhang in tissue culture medium.

siRNA molecules can be obtained through a variety of protocols including chemical synthesis or recombinant production using a *Drosophila* in vitro system. They can be commercially obtained from companies such as Dharmacon Research Inc. or Xeragon Inc., or they can be synthesized using commercially available kits such as the Silencer™ siRNA Construction Kit from Ambion (catalog number 1620) or HiScribe™ RNAi Transcription Kit from New England BioLabs (catalog number E2000S).

Alternatively siRNA can be prepared using standard procedures for in vitro transcription of RNA and dsRNA annealing procedures such as those described in Elbashir et al. (*Genes & Dev.,* 15:188-200, 2001), Girard et al., (*Nature* 442:199-202 (2006)), Aravin et al., (*Nature* 442:203-207 (2006)), Grivna et al., (*Genes Dev.* 20:1709-1714 (2006)), and Lau et al., (*Science* 313:363-367 (2006)). siRNAs are also obtained by incubation of dsRNA that corresponds to a sequence of the target gene in a cell-free *Drosophila* lysate from syncytial blastoderm *Drosophila* embryos under conditions in which the dsRNA is processed to generate siRNAs of about 21 to about 23 nucleotides, which are then isolated using techniques known to those of skill in the art. For example, gel electrophoresis can be used to separate the 21-23 nt RNAs and the RNAs can then be eluted from the gel slices. In addition, chromatography (e.g. size exclusion chromatography), glycerol gradient centrifugation, and affinity purification with antibody can be used to isolate the small RNAs.

siRNAs specific to the Tsix, Xite, Xist, Xic, or Xic flanking regions can also be obtained from natural sources. For example, as shown in FIG. 36 of PCT publication number WO 2007/053207, small RNAs are endogenously produced from the various sites within the mouse XIC. Such small RNAs can be purified as described above and used in the methods of the invention.

Short hairpin RNAs (shRNAs), as described in Yu et al. or Paddison et al. (*Proc. Natl. Acad. Sci. USA,* 99:6047-6052, 2002; *Genes & Dev,* 16:948-958, 2002; incorporated herein by reference), can also be used in the methods of the invention. shRNAs are designed such that both the sense and antisense strands are included within a single RNA molecule and connected by a loop of nucleotides (3 or more). shRNAs can be synthesized and purified using standard in vitro T7 transcription synthesis as described above and in Yu et al. (supra). shRNAs can also be subcloned into an expression vector that has the mouse U6 promoter sequences which can then be transfected into cells and used for in vivo expression of the shRNA.

A variety of methods are available for transfection, or introduction, of dsRNA into mammalian cells. For example, there are several commercially available transfection reagents useful for lipid-based transfection of siRNAs including but not limited to: TransIT-TKOT™ (Mirus, Cat. # MIR 2150), Transmessenger™ (Qiagen, Cat. #301525), Oligofectamine™ and Lipofectamine™ (Invitrogen, Cat. # MIR 12252-011 and Cat. #13778-075), siPORT™ (Ambion, Cat. #1631), DharmaFECT™ (Fisher Scientific, Cat. # T-2001-01). Agents are also commercially available for electroporation-based methods for transfection of siRNA, such as siPORTer™ (Ambion Inc. Cat. #1629). Microinjection techniques can also be used. The small RNA can also be transcribed from an expression construct introduced into the cells, where the expression construct includes a coding sequence for transcribing the small RNA operably linked to one or more transcriptional regulatory sequences. Where desired, plasmids, vectors, or viral vectors can also be used for the delivery of dsRNA or siRNA and such vectors are known in the art. Protocols for each transfection reagent are available from the manufacturer. Additional methods are known in the art and are described, for example in U.S. Patent Application Publication No. 20060058255.

The concentration of dsRNA used for each target and each cell line varies and can be determined by the skilled artisan. If desired, cells can be transfected multiple times, using multiple small RNAs to optimize the gene-silencing effect.

Cells

Embryonic stem cells (ES), derived from the inner cell mass of preimplantation embryos, have been recognized as the most pluripotent stem cell population and are therefore the preferred cell for the methods of the invention. These cells are capable of unlimited proliferation in vitro, while maintaining the capacity for differentiation into a wide variety of somatic and extra-embryonic tissues. ES cells can be male (XY) or female (XX); female ES cells are preferred.

Multipotent, adult stem cells can also be used in the methods of the invention. Preferred adult stem cells include hematopoietic stem cells (HSC), which can proliferate and differentiate throughout life to produce lymphoid and myeloid cell types; bone marrow-derived stem cells (BMSC), which can differentiate into various cell types including adipocytes, chondrocytes, osteocytes, hepatocytes, cardiomyocytes and neurons; and neural stem cells (NSC), which can differentiate into astrocytes, neurons, and oligodendrocytes. Multipotent stem cells derived from epithelial and adipose tissues and umbilical cord blood cells can also be used in the methods of the invention.

Stem cells can be derived from any mammal including, but not limited to, mouse, human, and primates. Preferred mouse strains for stem cell preparation include 129, C57BL/6, and a hybrid strain (Brook et al., *Proc. Natl. Acad. Sci. U.S.A.* 94:5709-5712 (1997), Baharvand et al., *In Vitro Cell Dev. Biol. Anim.* 40:76-81 (2004)). Methods for preparing mouse, human, or primate stem cells are known in the art and are described, for example, in Nagy et al., *Manipulating the mouse embryo: A laboratory manual,* $3^{rd}$ ed., Cold Spring Harbor Laboratory Press (2002); Thomson et al., *Science* 282:1145-1147 (1998), Marshall et al., *Methods Mol. Biol.* 158:11-18 (2001); Thomson et al., *Trends Biotechnol.* 18:53-57 (2000); Jones et al., *Semin. Reprod. Med.* 18:219-223 (2000); Voss et al., *Exp. Cell Res.* 230:45-49 (1997); and Odorico et al., *Stem Cells* 19:193-204 (2001).

ES cells can be directly derived from the blastocyst or any other early stage of development, or can be a "cloned" stem cell line derived from somatic nuclear transfer and other similar procedures. General methods for culturing mouse, human, or primate ES cells from a blastocyst can be found in Appendix C of the NIH report on stem cells entitled *Stem Cells: Scientific Progress and Future Research Directions* (this report can be found online at the NIH Stem Cell Information website, http://stemcells.nih.gov/info/scireport). For example, in the first step, the inner cell mass of a preimplantation blastocyst is removed from the trophectoderm that surrounds it. (For cultures of human ES cells, blastocysts are generated by in vitro fertilization and donated for research.) The small plastic culture dishes used to grow the cells contain growth medium supplemented with fetal calf serum, and are sometimes coated with a "feeder" layer of nondividing cells. The feeder cells are often mouse embryonic fibroblast (MEF) cells that have been chemically inactivated so they will not divide. Additional reagents, such as the cytokine leukemia inhibitory factor (LIF), can also be added to the culture medium for mouse ES cells. Second, after several days to a week, proliferating colonies of cells are removed and dispersed into new culture dishes, each of which may or may not contain an MEF feeder layer. If the cells are to be used to human therapeutic purposes, it is preferable that the MEF feeder layer is not included. Under these in vitro conditions, the ES cells aggregate to form colonies. In the third major step required to generate ES cell lines, the individual, nondifferentiating colonies are dissociated and replated into new dishes, a step called passage. This replating process establishes a "line" of ES cells. The line of cells is termed "clonal" if a single ES cell generates it. Limiting dilution methods can be used to generate a clonal ES cell line. Reagents needed for the culture of stem cells are commercially available, for example, from Invitrogen, Stem Cell Technologies, R&D Systems, and Sigma Aldrich, and are described, for example, in U.S. Patent Application Publication Numbers 20040235159 and 20050037492 and Appendix C of the NIH report, *Stem Cells: Scientific Progress and Future Research Directions,* supra.

Although the preferred methods of the invention include transfection of the transgene into the stem cell after the stem cell line has been established, it is also possible to generate a chimeric transgenic mouse having the transgene integrated into the mouse chromosome. The transgene would then be present in the germ line and the mouse would be mated to produce embryos with an integrated transgene. The inner cell mass of a preimplantation blastocyst having the integrated transgene is removed from the trophectoderm that surrounds it and used to establish a stem cell line as described above.

Transfection of Transgenes

After a stem cell line has been established, the cells can be transfected or transduced (for viral vectors), with a transgene of the invention to prevent or control stem cell differentiation. Transgenes may be integrated into the chromosome or may be episomal depending on the methods used for delivery of the transgene. Methods for delivery of a transgene into cells using plasmids or viral vectors are known in the art. Suitable methods for transfecting or infecting host cells can be found in Sambrook et al. (*Molecular Cloning: A Laboratory Manual*, 2nd Edition, Cold Spring Harbor Laboratory press (1989)); Goeddel et al., (*Gene Expression Technology: Methods in Enzymology*, Academic Press, San Diego, Calif. (1990); Ausubel et al. (*Current Protocols in Molecular Biology* John Wiley & Sons, New York, N.Y. (1998); Watson et al., *Recombinant DNA*, Chapter 12, 2nd edition, Scientific American Books (1992); and other laboratory textbooks. For a review of methods for delivery of a transgene see Stull, *The Scientist*, 14:30-35 (2000). Recombinant plasmids or vectors can be transferred by methods such as calcium phosphate precipitation, electroporation, liposome-mediated transfection, gene gun, microinjection, viral capsid-mediated transfer, or polybrene-mediated transfer. For a review of the procedures for liposome preparation, targeting and delivery of contents, see Mannino and Gould-Fogerite, (*Bio Techniques*, 6:682-690, 1988), Feigner and Holm, (*Bethesda Res. Lab. Focus,* 11:21, 1989) and Maurer (*Bethesda Res. Lab. Focus,* 11:25, 1989). For viral transduction, viral vectors are generally first transferred to a helper cell culture, using the methods described above, for the production of virus. Viral particles are then isolated and used to infect the intended stem cell line. Techniques for the production and isolation of viral particles and the use of viral particles for infection can also be found in the references cited above and in U.S. Patent Application Publication Number 20040241856.

There are a variety of plasmids and viral vectors useful for delivery of a transgene and these are known in the art. See, for example, Pouwels et al., *Cloning Vectors: A Laboratory Manual* (1985). Supp. 1987) and the references cited above. Plasmids and viral vectors are also commercially available, for example, from Clontech, Invitrogen, Stratagene, and BD Biosciences.

In general, preferred plasmids or viral vectors include the following components: a multiple cloning site consisting of restriction enzyme recognition sites for cloning of the transgene, and a eukaryotic selectable marker (positive or negative) for selection of transfected or transduced cells in media supplemented with the selection agent. Preferred selectable markers include drug resistance markers, antigenic markers, adherence markers, and the like. Examples of antigenic markers include those useful in fluorescence-activated cell sorting. Examples of adherence markers include receptors for adherence ligands that allow selective adherence. Other selection markers include a variety of gene products that can be detected in experimental assay protocols, such as marker enzymes, amino acid sequence markers, cellular phenotypic markers, nucleic acid sequence markers, and the like. In general, positive selection marker genes are drug resistance genes. Suitable positive selection markers include, for example, nucleic acid sequences encoding neomycin resistance, hygromycin resistance, puromycin resistance, histidinol resistance, xanthine utilization, zeocin resistance, and bleomycin resistance. The positive selection marker can be operably linked to a promoter in the nucleic acid molecule (e.g., a prokaryotic promoter or a phosphoglycerate kinase ("PGK") promoter).

In general, negative selection marker genes are used in situations whereby the expressed gene product leads to the elimination of the host cell, for example, in the presence of a nucleoside analog, such as gancyclovir. Suitable negative selection markers include, for example, nucleic acid sequences encoding Hprt, gpt, HSV-tk, diphtheria toxin, ricin toxin, and cytosine deaminase.

Plasmids or viral vectors can also contain a polyadenylation site, one or more promoters, and an internal ribosome entry site (IRES), which permits attachment of a downstream coding region or open reading frame with a cytoplasmic polysomal ribosome to initiate translation in the absence of internal promoters. IRES sequences are frequently located on the untranslated leader regions of RNA viruses, such as the Picornaviruses. The viral sequences range from about 450-500 nucleotides in length, although IRES sequences may also be shorter or longer (Adam et al. *J. Virol.* 65: 4985-4990 (1991); Borman et al. *Nuc. Acids Res.* 25: 925-32 (1997); Hellen et al. *Curr. Top. Microbiol. Immunol.* 203: 31-63 (1995); and Mountford et al. *Trends Genet.* 11: 179-184 (1995)). The encephalomyocarditis virus IRES is one such IRES which is suitable for use in this invention.

Plasmids or viral vectors can also include a bacterial origin of replication, one or more bacterial promoters, and a prokaryotic selectable marker gene for selection of transformed bacteria and production of the plasmid or vector. Bacterial selectable marker genes can be equivalent to or different from eukaryotic selectable marker genes. Non-limiting examples of preferred bacterial selectable marker genes include nucleic acids encoding ampicillin resistance, kanamycin resistance, hygromycin resistance, and chloramphenicol resistance.

Desirably, plasmids or viral vectors will also include sequences for the excision and removal of the transgene. Recombinase recognition sequences useful for targeted recombination are used for methods of controlling differentiation and are described in detail below. Non-limiting examples of recognition sequences that can be included in the plasmids or vectors used in the invention are loxP sequences or FRT sequences. The loxP site consists of two 13-bp inverted repeats flanking an 8-bp nonpalindromic core region. The loxP sequence is a DNA sequence comprising the following nucleotide sequence (hereinafter this sequence is referred to as the wild type loxP sequence):

```
                                          (SEQ ID NO: 41)
     5'-ATAACTTCGTATA ATGTATGC TATACGAAGTTAT-3'

(SEQ ID NO: 42)
     3'-TATTGAAGCATAT TACATACG ATATGCTTCAATA-5'
```

However, the loxP sequence need not be limited to the above wild type loxP sequence, and part of the wild type loxP sequence may be replaced with other bases as long as the two "recombinase recognition sequences" become substrates for the Cre recombinase. Furthermore, even those loxP sequences (mutant loxP sequences) that normally do not become substrates for recombinase Cre in a combination with the wild type loxP sequence but become substrates for recombinase Cre in a combination with the mutant loxP sequences of the same sequence by base replacement of the wild type loxP sequence (i.e., sequences for which the entire process of cleavage, exchange, and binding of DNA strands takes place) are included in the recognition sequences of recombinase Cre. Examples of such mutant loxP sequences are described in Hoess et al., (*Nucleic Acids Res.* 14:2287-2300 (1986)), in which one base in a spacer region of the wild type loxP sequence has been replaced and Lee et al., (*Gene* 14:55-65 (1998)), in which two bases in the spacer region have been replaced.

FLP recognition sequences include any sequence that becomes a substrate for recombinase FLP, wherein FLP causes the entire process of cleavage, exchange, and binding of DNA chains between two recombinase recognition sequences. Examples include the FRT sequence, which is a 34-base DNA sequence (Babineau et al., *J. Biol. Chem.* 260: 12313-12319 (1985)). As described for the Cre recognition sequences above, an FLP recognition sequence is not limited to the above wild type FRT sequence. Part of the wild type FRT sequence may be replaced with other bases as long as two FLP recombinase recognition sequences can become substrates for FLP recombinase. Furthermore, even those FRT sequences (mutant FRT sequences) that normally do not become substrates for recombinase FLP in a combination with the wild type FRT sequence but become substrates for recombinase in a combination with the mutant FRT sequences of the same sequence by base replacement of the wild type FRT sequence (i.e., sequences for which the entire process of cleavage, exchange, and binding of DNA strands takes place), are included in the FLP recognition sequences. For examples of FRT sequences, see McLeod et al., *Mol. Cell. Biol.*, 6:3357-3367 (1986).

Non-limiting examples of viral vectors useful in the invention include adenoviral vectors, adeno-associated viral vectors, retroviral vectors, Epstein-Barr virus vectors, lentivirus vectors, herpes simplex virus vectors, and vectors derived from murine stem cell virus (MSCV) and hybrid vectors described by Hawley (*Curr. Gene Ther.* 1:1-17 (2001). Numerous vectors useful for this purpose are generally known and have been described (Miller, *Human Gene Therapy* 15:14, 1990; Friedman, *Science* 244:1275-1281, 1989; Eglitis and Anderson, *BioTechniques* 6:608-614, 1988; Tolstoshev and Anderson, *Current Opinion in Biotechnology* 1:55-61, 1990; Sharp, *The Lancet* 337:1277-1278, 1991; Cornetta et al., *Nucleic Acid Research and Molecular Biology* 36:311-322, 1987; Anderson, *Science* 226:401-409, 1984; Moen, *Blood Cells* 17:407-416, 1991; Miller and Rosman, *Biotechniques* 7:980-990, 1989; Rosenberg et al., *N. Engl. J. Med* 323:370, 1990, Groves et al., *Nature,* 362:453-457, 1993; Horrelou et al., *Neuron,* 5:393-402, 1990; Jiao et al., *Nature* 362:450-453, 1993; Davidson et al., *Nature Genetics* 3:2219-2223, 1993; Rubinson et al., *Nature Genetics* 33, 401-406, 2003; Buning et al., (*Cells Tissues Organs* 177:139-150 (2004)); and Tomanin et al., *Curr. Gene Ther.* 4:357-372 (2004).

In one preferred example, an Epstein Barr virus (EBV) based vector is used which remains episomal and can propagate indefinitely. In this example, the recombinase sequences are introduced around the EBV replication origin and after treatment with the appropriate recombinase, the origin of replication is lost and the episomal sequences will no longer propagate resulting in loss of the episomal sequences.

Non-limiting examples of plasmids useful in the invention include pSG, pSV2CAT and PXt1 from Stratagene, and pMSG, pSVL, pBPV, and pSVK3 from Pharmacia.

The above-described methods for introducing transgenes of the invention into stem cells can also be used for delivery of therapeutic genes to the stem cells before or after differentiation has been blocked.

Assays for Transgene Expression

Once a stem cell culture has been infected, transfected, or microinjected with the transgene or small RNA molecule, cells are cultured in selection media to isolate cells that stably express the plasmid or viral vector that contains the transgene. Selection methods are generally known in the art and include, for example, culturing of cells in media containing a selection agent for selection of cells expressing the appropriate selectable marker gene. The selectable marker gene can encode a negative selection marker, a positive selection marker or a fusion protein with positive and negative selection traits. Negative selection traits can be provided in situations whereby the expressed gene leads to the elimination of the host cell, frequently in the presence of a nucleoside analog, such as gancyclovir. Positive selection traits can be provided by drug resistance genes. Suitable negative selection markers include, for example, nucleic acid sequences encoding Hprt, gpt, HSV-tk, diphtheria toxin, ricin toxin, and cytosine deeaminase. Suitable positive selection markers include, for example, nucleic acid sequences encoding neomycin resistance, hygromycin resistance, puromycin resistance, histidinol resistance, xanthine utilization, Zeocin resistance, and bleomycin resistance. Drug resistant cells can either be pooled for a mixed population or colonies can be individually selected (e.g., small groups of about 25 to 1000 cells, preferably, 25 to 500 cells, and most preferably 25 to 100 cells) and plated to generate clonal cell lines or cell lines in which a high proportion (80%, 85%, 90%, 95% or more) of the cells express the transgene.

Genetic alteration of stem cells is rarely 100%, and the population of cells that have been successfully altered can be enriched, for example, by co-transfection of the transgene with a label such as GFP or an immunostainable surface marker such as NCAM which can be used to identify and isolate transfected cells by fluorescence-activated cell sorting.

Cells expressing the transgene can be assayed for the presence of markers of proliferation, indicators of an undifferentiated cell, or the absence of indicators of differentiation to determine if differentiation has been successfully prevented. Examples of assays for differentiation are described below.

Cell lines that express the transgene and are blocked from differentiating are included in the invention. Such cells can be maintained indefinitely and used for any therapeutic purpose requiring a stem cell, such as those described herein. Such cells can also be genetically modified with a therapeutic transgene. For example, a "master" mammalian (e.g., human) ES cell line or a "master" mammalian (e.g., human) adult stem cell line of the invention can be genetically modified for use in the treatment of neurodegenerative disorders (e.g., Alzheimer's or Parkinson's or traumatic injury to the brain or spinal cord), hematologic disorders (e.g., sickle cell, thalassemias), muscular dystrophies (e.g., Duchenne's muscular dystrophy), endocrine disorders (e.g., diabetes, growth hormone deficiency), Purkinje cell degeneration, heart disease, vision and hearing loss, and others.

Differentiation

Cells in which differentiation is effectively blocked by the introduction of a transgene or small RNA molecule using the methods of the invention can be assayed by detecting phenotypic characteristics of undifferentiated cells or by detecting either the presence of markers specific for undifferentiated cells, or the absence of markers or characteristics of differentiated cells.

The morphology of the undifferentiated stem cell is distinct from that of the differentiated stem cell and morphological characteristics can be used to identify stem cells that are successfully transfected with the transgene and that remain in the undifferentiated state. Generally, ES cells are immortalized and have a rounded morphology, a high radiance level, and very little cellular outgrowth on gelatinized plates. Methods for detecting morphology of the transfected stem cells are also known in the art.

Markers that indicate the undifferentiated state or that indicate the absence of differentiation can also be used. In the first instance, markers such as stage-specific embryonic antigen (SSEA) 1, 3, and 4, surface antigens TRA-1-60 and TRA-1-81, alkaline phosphatase, Nanog, Oct-4, and telomerase reverse transcriptase are all indicators of the undifferentiated state of the stem cell for mouse, primate, or human cells. A molecular profile of additional genes expressed by undifferentiated ES cells that can be used to monitor ES cell differentiation are described in Bradenberger et al., (*BMC Dev. Bio.* 4:10 (2004)).

In the second instance, undifferentiated cells can be identified by the absence of markers of differentiation. Exemplary markers of differentiation include any protein or mRNA that is characteristic of a particular differentiated cell and will be known to the skilled artisan. For example, cells that have differentiated into neurons will express tyrosine hydroxylase, cells that have differentiated into oligodendrocytes will express NG2 proteoglycan, A2B5, and PDGFR-α, and will be negative for NeuN, cells that have differentiated into T lymphocytes will express CD4 and CD8, and cells that have differentiated into a mature granulocyte will express Mac-1.

Additional examples of markers of differentiated and undifferentiated cell types can be found at the in Appendix E of the NIH report stem cells entitled *Stem Cells: Scientific Progress and Future Research Directions*, supra. Methods for detecting the expression of protein markers, transcription factors, or surface antigens or the mRNA or genes encoding these (e.g., the Pou5f1 gene that encodes the Oct-3/Oct-4 transcription factor) are known in the art and include, for example, immunstaining, immunoblotting, immunohistochemistry, PCR, southern blotting, northern blotting, RNase protection assays, and in situ hybridization.

Inactivation of Transgenes

For applications (e.g., therapeutic applications) that require control of the switch from the undifferentiated state to the differentiated state, the transgene is inactivated to reduce or eliminate the block to differentiation. In preferred embodiments, the transgene is inactivated by removal of the transgene using, for example, site specific recombination methods. For such applications, the genetically modified stem cell is maintained for a suitable time period sufficient for manipulation or handling (e.g., 1 to 90 days, preferably 1 to 45 days, more preferably 1 to 30 days or 1 to 10 days) prior to removal of the transgene.

Any site specific recombinase/DNA recognition sequence known in the art can be used to remove the transgene from the stem cells of the invention. One example of a site-specific recombinase is Cre recombinase. Cre is a 38-kDa product of the cre (cyclization recombination) gene of bacteriophage P1 and is a site-specific DNA recombinase of the Int family (Sternberg et al., *J. Mol. Biol.* 187: 197-212 (1986). Cre recognizes a 34-bp site on the P1 genome called loxP (locus of X-over of P1) and efficiently catalyzes reciprocal conservative DNA recombination between pairs of loxP sites. The loxP site consists of two 13-bp inverted repeats flanking an 8-bp nonpalindromic core region. Cre-mediated recombination between two directly repeated loxP sites results in excision of DNA between them as a covalently closed circle. Cre-mediated recombination between pairs of loxP sites in inverted orientation will result in inversion of the intervening DNA rather than excision. Breaking and joining of DNA is confined to discrete positions within the core region and proceeds one strand at a time by way of transient phophotyrosine DNA-protein linkage with the enzyme. Additional examples of site-specific recombination systems include the integrase/att system form bacteriophage lambda and the FLP (flippase)/FRT system from the *Saccharomyces cerevisiae* 2pi circle plasmid. Additional details on these and additional or modified recombinase/DNA recognition sequences and methods for using them can be found, for example, in U.S. Pat. Nos. 4,959,317; 5,527,695; 6,632,672; and 6,734,295; Kilby et al. *Trends Genet.* 9:413-421 (1993); Gu et al. *Cell* 73:1155-1164. (1993); Branda et al., *Dev.* 6:7-28 (2004); Sauer *Endocrine* 19:221-228 (2002; Pfeifer et al., *Proc. Natl. Acad. Sci.* 98:11450-11455 (2001), and Ghosh et al., *Methods* 28:374-83 (2002).

Assays for Transgene Inactivation

After the genetically altered stem cells have been maintained for the desired period of time, successful inactivation of the transgene or small RNA molecule (for example, by natural degradation) can be assayed using a variety of techniques that will be known to the skilled artisan. For example, the ability of the cells to grow in selection media can be used as an assay for the successful removal of the transgene. In this example, the use of the recombinase eliminates all transgene sequences (except for one remaining recognition site) including the selectable marker gene. As a result, the cells lose the ability to grow in positive selection media. Cells can be seeded and grown into clonal cell lines using standard limiting dilution methods. Clonal cell lines can be replica plated and one set can be cultured in the presence of the selection agent while the second is cultured in the absence of selection agent. Cells that have lost their ability to grow in the selection media are identified as cells that have lost the transgene. The matched set of these cells can then be grown in the absence of the selection media, expanded, and used as desired.

While removal of the transgene should be sufficient to induce X chromosome inactivation and potentiate differentiation of the cells, in some cases additional factors may be required to fully induce differentiation or to induce differentiation into a desired cell type. Such factors are described, for example, in U.S. Patent Application Publication Number 20050037492 and in Appendix D of the NIH report stem cells entitled *Stem Cells: Scientific Progress and Future Research Directions*, supra.

Identification of phenotypic characteristics of differentiation or markers of differentiation, as described above, can also be used to identify cells in which the transgene is inactivated and the cells have successfully undergone differentiation.

As described above, the transgenes are known to block X chromosome inactivation. Accordingly, assays for X chromosome inactivation, include nucleation of chromosome pairing, can also be used to identify cells in which the transgene is inactivated and/or that no longer harbor the transgene. Examples of such assays are described herein (e.g., fluorescent in situ hybridization (Ogawa et al., supra) or in Lee et al., *Cell* (1999), supra, Stavropoulos et al., *Proc. Natl. Acad. Sci.* 98:10232-10237 (2001), Lee, *Nature Genetics* (2002), supra, and Ogawa et al., supra.

Combination Methods

Any of the transgenes described herein can be used in combination with additional transgenes described herein to enhance the desired effects. In addition, a combination of the use of siRNA with one or more transgenes of the invention can also be used to achieve the desired effects. If desired, the methods described herein may be combined with additional methods known in the art to reduce differentiation in stem cells. Such methods include growth on a feeder layer of mouse embryonic fibroblast cells, growth in Matrigel™, the addition of leukemia inhibitory factor to the culture medium, and the addition of map kinase kinase inhibitors such as PD98059 (Sigma, catalog number P215-5MGA), LIF, Oct-4, Gab1, STAT3, or FGF, (or factors that activate the activity or expression of these proteins) to the culture media (see, for example, the methods described in Xu et al., *Nature Biotech.* 19:971 (2001), Amit et al., *Biol. Reprod.* 70:837-45 (2004), PCT Publication Number WO 01/51616, and U.S Patent Application Publication Numbers 20040235159 and 20050037492).

Therapeutic Applications

The methods for regulating differentiation of stem cells described herein have numerous clinical, agricultural, and research uses that will be appreciated by the skilled artisan. Stem cells have enormous clinical potential because of their ability to differentiate into any cell type of the body. The cells can be used as the starting point for the generation of replacement tissue or cells, such as cartilage, bone or bone cells, muscle or muscle cells, neuronal cells, pancreatic tissue or cells, liver or liver cells, fibroblasts, and hematopoetic cells. Using the methods described herein, the clinician or researcher can introduce the appropriate transgene into the stem cells to prevent differentiation and then remove the transgene just prior to administering the cell product to the patient. If small RNA is used, such small RNA will generally degrade naturally and does not need to be removed.

The methods for regulating differentiation of mammalian stem cells described herein, for example, can be used for the treatment of diseases treatable through transplantation of differentiated cells derived from ES cells. The ES cells are maintained in the undifferentiated state for a period of time sufficient to genetically manipulate the cells prior to differentiation either to reduce immunogenicity or to give new properties to the cells to combat specific diseases. Furthermore, the use of the methods for regulating differentiation described herein not only allow the practitioner sufficient time to genetically modify the stem cells but, because of the ability of the stem cell to self-renew, allow for the gene to be maintained throughout successive cell divisions, thereby circumventing the need for repeated transgene introduction.

Stem cells of the invention or produced using the methods of the invention can be used to treat, for example, neurodegenerative disorders (e.g., Alzheimer's or Parkinson's or traumatic injury to the brain or spinal cord), hematologic disorders (e.g., sickle cell, thalassemias), muscular dystrophies (e.g., Duchenne's muscular dystrophy), endocrine disorders (e.g., diabetes, growth hormone deficiency), Purkinje cell degeneration, heart disease, vision and hearing loss and others in any mammal, preferably a human. Additional examples of the use of genetically modified stem cells in experimental gene therapies are described in Chapter 11 of NIH report stem cells entitled *Stem Cells: Scientific Progress and Future Research Directions*, supra and also in Shufaro et al., *Best Pract. Res. Clin. Obstet. Gynaecol.* 18:909-927 (2004).

The cells and methods of the invention can also be used for agricultural purposes to clone desirable livestock (e.g., cows, pigs, sheep) and game. For such purposes, the appropriate species of stem cell line and transgene are used.

Research Applications

The invention can also be used for research purposes for the study of differentiation or development, and for the generation of transgenic animals useful for research purposes. The stem cells and the methods for regulating the differentiation of the stem cells described herein can be used, for example, to identify signaling pathways or proteins involved in differentiation processes, which can lead to the identification of future therapeutic targets for the treatment of a variety of diseases. The stem cells and methods of the invention can also be used to study the effects of a particular gene or compound on stem cell differentiation, development, and tissue generation or regeneration.

EXAMPLES

The invention is further described and illustrated in the Examples set forth in PCT publication number WO 2007/053207, herein incorporated by reference, and in Boumil et al. (*Mol. Cell. Biol.* 26:2109-2117 (2006)), Cohen et al. (*Dev. Cell* 12:57-71 (2007)), and Xu et al. (*Science* 311:1149-1152 (2006)), and Donohoe et al. (*Mol. Cell.* 25:43-56 (2007)).

Other Embodiments

All publications, patent applications, and patents, mentioned in this specification, and including U.S. Provisional Application Ser. No. 60/697,301, filed on Jul. 7, 2005, and PCT publication number WO 2007/053207, filed Jun. 30, 2006 and published May 10, 2007, are incorporated herein by reference.

While the invention has been described in connection with specific embodiments, it will be understood that it is capable of further modifications. Therefore, this application is intended to cover any variations, uses, or adaptations of the invention that follow, in general, the principles of the invention, including departures from the present disclosure that come within known or customary practice within the art.

SEQUENCE LISTING (52 sequences)

SEQ ID NO: 1 - DNA, 100000 bp, Mus musculus
ctaatgggacagaaggttttcagcctcttttgctttcagcttcttcgtttaggtaaaaggaacagagggacatattttatagaaaaggtggtgttaggggcgtaggtggcactgagatcattctggccacatcctgctgaattacaactcattattgggtggcagtctctgaatcagaggctggtatctgacttcacacatcagagggatagtgcttgtgtgttgcatggtggtttaggtaaatctggatagcacgtggagtagaaagggacctatggatataaaaatcaaaatggttattaacatggtaacagctcctataagcaagtcgattcaggatgagttctaaaaccatttgttccagaatttgataactacttccagtttttgttttgttttggtttttgttttgttttttttttttttttgttgttgttgttgtttgtttttttttttttggtttttttttttttggtttttcaagatagggtttctctgtatagccctggctgtcctggaactcactttgtagaccaggctggcctcgaactcagaaatccacctgcctctgcctcccgagtgctgggattaaaggcatgtgccaccatgcctggctccaggttttgaaatatggtcagctttgttgctgcaacctaacctagccagaatgacttacagaaaagctctgctgctttcccccaaagaggccaagtccccttttctctggccaagagatttaggcctcttctgttttggaggagtgactcctgccaagaaccctacctgataccagaccctttcttcgtttttacttttaaatacttattttatgcacatgagtgttttgcctgcatgcatgcataagtactgtgcatgagtgtctggtgcttgcacaggccagaagagtgagttgggtcccctagaacttactgcattggagttacaggcagttgttggtgctgggaaccaagattctctgggaaagcaacaagtgctcttaaccaactgcgcaggcccaatcctagattcttgttaaacactgagaaattgcatcaaggatttcctgtatggcttgcgataaggaatagtagtgtacaaagtacatagttcctgtgccaacatctgtcattaaccctaagattataaggaaagagtaggaaataatcacgtgtcttctattccacatgcaaccagtcaaagctctggttattgggagcaacatttatgttgggggctagggaataggtatagcagtggaaagtttcggtctagctgatgaggagacacaggtcaaggggaagaagccctgtttgaacagctggtgaggctaagggagagaaaacggagtaactgggagggtgccgattggggggggggggtttagatcattctaccaaactgaaagggtaagggtgccctcccatcaagtgttgaagtgtgatgctgtgaaagagacagggtaccacaaccttcaggatcaggtctgccacttggtggccttctccaggttagctggcctgcaagcttctgtctgattcttcctttttgttccgcccatctcactggagcaatactgggattatagatgtttcactgtgctccgggggacaaattcgggttgtctgagtagcactgcaagtgtttttactcagtggcccaactctctggtctggacctaggatcttgaactgggaggtctgagctgtctgcttttctgcaaactagcgtaggtgtactacaggaggagctggctggctggaggtcctacatcaaaacaaggtgagcgatgagacagactcctgaaagcacacacaccagggaaaattgtacaaactttaaatctttttctctcccttcccttcccttcccttcccttcccttcccttctcttttctttatagaaaatttattgcaactctccaaccgcacattactttttctcttcaacatcttgctccgcagcttccttcacgctttttgcttgggcattggcacaggccatgtgaagactggcaaaagccttagagttctcttctgtgtcgacgctggccttttcctttttgtacacattccgggtgggcatcacaggtcctgtcagttgggtggccaatttaagttcttcaacagaactgtctcccttcttcagagaaggcttcctgggggaaagtatgagctttgagcagtactcctttaggcgctgcatggtagcttgcagcgattcagtggatttgtttcgcctccttgggtccacagagatgccgatggtatgatttcttgtggttaccagtcaccctgagttcctccaggctgaagcccctgacagctcagaccttggtgtgtttttttttttgtttttgtttttgttttttcgagagagggtttctctgtgtagccctggctatcctggaactcactctgtagaccaggctggcctcgaactcagaaatccaccagcctctgcctcccaagtgctgggattaaaggcgtgcgccaccacggcccgacttggtgtggtatctaactgtagggcacttcacggtgggcctgaccggaccggatgcgggacgagtggcaatgcagcacgcttttgcctgccgagccctgagtctgcggatcttgcatggcagctggttgaaccaagtgtctactagctgctgccaatgtttgtggaagtggggcttcatgatcacgccattccggctggacgccatggctgcctcctgtacaggagaacgacagggcggagaggtcttccttctttctctatcctccctgacaaactttctctctctccctctccctccccccccccctctttggtttttcaagatagggtttctctgtgtagccctggctgtcctggaactcactttgtagaccaggctggccttgagctcagaaattcgcctgcttctgcctccctagtgctgggattaaaggcgtgcgccaccactgcctggcttgacaaactctcctgacacatggtatcatgtccttaagctggccttgaactcagtatgtagatgcttatgaccttgaacttctgatcctcatgcctctgtttcgtgctaggattacaggccagtgtccccaaacacgatttgagaatttattttcacagagatgcaatcatcatacaaccggtaaacggtgatctttcaacaaaagatggtgaaacaattgaccggatttcaaaacaaaacaaaacactcattcattatacaaatattcattctaatgaatactagatttaaaggtactaaagaaactttatatgacatctatggagaaaaaaaaaggaaaacttgtgcgttgtttggaaatggctttgaaggaacagtcctagttctagctggtaaatctggacttctccacatgcatcagcgaccaggagactattttacacacagagttaaatgcagaagtgactagacatttcaggaccagttttcctatggtcagaggaaagttaaaaaaacaaacaaacaaacaatactacctccattacagagtcctccgtgtattcatgtttattttcataaataacacagatagctacacactgagataattaaccaggcaccagcattactatatacatgtattttctaggttgctgcttagtccagaagcaatgaagcttcaccggttaaaggacactcaatactcacacaataccttctaaatctgtttttcaacaggaagtacccaggctcctcatagaaatggctagggatagacatagtgaaggcgaactacaaggtaagcatcactatcttagagtacacgaagcactggggaggtgatggcagcaagagccattctggactacataagaccctatcacacaggagaaaaaaagtagagattgtaaagggtaaattgataattaggggctggagagatggctcattgctgttccagaggacctgccttcattcccagcatccacatggcagctcacaatttcagttccagtggatctgaccacctcttcactaagacatcaagagaagtggctgggacatgtgttaacaagcacaagaatagtcgggcagtggtggagcaacgactttaatcccatcacttgggaggcagaagcagatggatttctgagttcaaggccatcgtggtctacagagtgagttccaggacagccaggactgcacagagaaaccctgtctcaaaacaccaaaccaaccaaccaaacaaacaaacaaacaaaagcaagcacaagaatcaaaagcataaaaaatgaggaaatttgttctcccttctgggattttcttcatttatgtgctcagggcacacagaaggttgaggagaacactgggaaatgacccacggaccacacattttaggcataaacagtgtggggagagttggaaaaaaaatccacacagaagcacacacacaaagaagccctacttagatcttcctctcctatacagaacaaaatccttattccatacaagaagggcaacaaatactacagcctctggccagttgtgaaagccatctgaccctggtgaatggacaggaaggggttaaataaaaacagttccggggaaaaggtagaaataaatactgtgtctaaatttgggaaagggagcagggggcaggagtagggagcaggaatccaccacacaatccaagactgagatataataaaccagcagatgaggcacactccctgccagtcacaaggctaaggagcactacagtacagcactacaacataaggcttactacagaagtaaagacagttacgtggaacaagagctctgagacacagcgcaaaaaccacctgagagtaatggagttatttaggaaaccagaggcaatggctccctgtcaaacaccctacaaagatgtatcactctgagaaaagcaagccgcagcttcatctccagagcagtggggcagaggcttaggccaggatgaaggaagacagagcccagaaagacatcctcaagaaaactgattaggaacacaatgggggaaggcaaaagcctaagagtggaaagcaacaaacaggaaattctaactggctgaaggtactaaactagtctaactcatcacttagtctgccttatgtgaaagctcactagtaggaagtgacagattgaataagagaaaaagcttgcaaattaaaggtagctatccacgagtctcatttaatttagaagcttacatgtaaccctattttccactggggagcaggaaagtggaggatgtttacactttaagtgggagtagtaaagtcgtttttatgagaattcaataaacttaagagaaacatagaatgggctaggactttctgttgagcctataaaccagtgagtggtactcgaactaccatagatgacaacccctttggcaaacctctatctccgaaaatatttacattgtgattcataatagtagcaaaactacagctatgaagtggcaatggaaataattttatggttgagaatcaccgcaacatgaggaactgcattaaagggccacgagcagcattaggaaggctgagaaccactgctctagacagacatctgcttgtgtactatttttatggaatttttatttttttctagacagggtttctctgtgtagccctggctgtcctggaactcactctgtagaccaaactggcctcgaactcagagatctgcctgcctctgcctcccaagtgctgggattaaaggcatgtgccaccactgcccggcttttatggactattaaatgaaacctaaggctaaggcagtgatgtagggagggcaaaggtgtatctaggaatatatagtttccaatttccccttgtggcacaaatcagtttaatgaaaacctaaggaaaagccagggatggcggtgcatgcactctgagttcagggacagcctggtctacagagtgagatccaggacagccagggctacactatctctaaggggaaaagaaaagaaaagaaaagaaaagaaaagaaaagaaaagaagggaaggggaaggggaaagggaaagggaaaggaaaagaagggaagggaagggaagagaagagaagagaagagaagagaagagaagagaagagaagagaagagaagagaagagaactcaagaaagagaatagaggtgattattatattcctcagcaggtctgagctgtataagcagaccaaagtatactttcctagtatcttctactctcatttgataaagcaagcataataaagcactgtgtttgggagtggccattcttggactccttcataggcttcaaacactacctttacaaaaggatacaaatttatttgagtgacattttagaacaacattaccaagagccatgggagagatgggggagatagttcaatgggcaaagtgcttgcatgaagacttgagttcagatcccaagcacatctttagaagctgagcatgacggcacagtgcagcactcatggatagaaacagatggctcccacaggcttgctggccagctccaggttcagtaagaaaccctgtgtatcagtcacttttctgatattgtgataaaacgtggccaaggcaacttagataaaaaaagagtttatttgggcttacagttccatgacagagtggaggtggcaggcagcaggcatggtagctggagcagccaagttgaacatcttgaactgcaagcataaggcagagacagtgaagtcaaaatggtgcaaatttttaaactctcaaagcctgcctccagtgacataattccatcaacaagactgtgcctccctagcctttccaaacaatggcagcaactagggaccaagtatcccaatgcctgagactatggtggatatctcgttcaaactaccacaccctatctcaaaaacataaggtaggttgactcagatcttccagaggatgtaggttcattcacagcacctataagacacctataaacaggtgttttacaactgtcaacagctccatcccaggggatccaggtccctcttcctgcctcccctgaacacctagcacacaagtggtatgcagacatatgtcagcactctggacgtagaggcaggtagatttctgtgagttctggggccagcatggtctacagagtaagtttcaggacagccaaggctacacagagagaccctgtctcaaagaaaacaattaaaactaaaaaacaaagtgaagcacaatagaggaagacacccaaagtcaacctctaatcacatgacgtgtgtacgtgtgtgcatccgtgtgcgagaaaacagacacacacagacacacacacacacaatgcctgggacaaaaacaatagattagcacataattaatacaaagtgatagttcaatatgataacaagaaccagagattaaattcaatgctgttctcccctaagaatgacaccgaggatgtagtataaataataagcactttagttgaagtcctgtcaaatcgtgaattgaaaaaaggagaccataccaatcaactctaaaacataggaagacacactactcaaagtcgctctgatgaacagagtatagttcatcaagcctatatccctgcattctggaaactaagaaagaagattgcagggggcagaggcaggcagatttctgagtttgaggccagcctggtctgcagagtgagttccaggacagccggggctacacagagaaaccctctctttaaaaaaccgggaaaaaaaaagattgctgggagtttagggcaggcctaggctaccagtgatttctaggctagcctgtactgcagagtaagactttgtctcagaaacaccctccaataaaagaaatcactgcaacatattaattacataaaatattcaagtttcaataaagacggaaagatatacaaggaagtgggagggtaggatctgtataaggaacagaaactttagtgatagaaaatgacttaaaaaacacagttcacacctgacacctgggactgctaatgacaacaggagctagaaagtgctcaaaccatttagggtatgaaccttgaaagaaatagctctgagttctatccttggccagaaactgggacatgcccttgctcctgtcttgtcaggagaccagaaatgcaaaaacaaccactatcataagagaaagagaaaataatttatgaatatcaacagttaaagaagagcccccagagcaccccacattaagtctggcaatggtgatactaacgtttgctaaatgaagacaaaaggaagtaatttcttgggaaacagaagttgtcatcgttgggttataagacaaagataaggagaagcacattgatctactgtagaaaccaaatccaggacaataaaggcctccatgatgtgtgacacatcatcaggcttcgtctccagtcaacaccagctcaggcaggcctcccgctcttgtttgtaggagaaagaggaggctaagtcgggaggagcacggcaagtttggggctcactcaacacggtgcatgccacatagcctacagggtaaaactgtgtctttaaaacagaaacaagcaagcaaagaaacaacaaaatcctcagctttcctaaaacaactgaaaagcaaaagccacttcccaactatcggtccagattaccctgataatcaaaaccaaagagaaagcaaacaagtaaacgaaaatcaaaaatacaaatcagtattgcttgggtacaaagactataacaaaatattacatttaattaaataccacctgaaaggaattcgagtttgggagatatgtcagtgtgaaatgttttctgtgtacatatgagggcttagttaggatcccagccaccgtttttttttttcttttttctttttgtaggcagtatgacagcatctgtcaattcagcgctgggaggtagagatggcaagatcatagggcttataggaagagaacatactacaggcaaatgtagtttattgccagaccccaggggaggttaaacgttttaaaagtcaatccataatgagctaggcacggtggaccatacctgaaatcctagcccctgggaagcagggcagaaggattgggacttcaagggtaagctagactacaagcaagactttatcttaaatttgaattagttaagtaactaattcattaactaattaatgattttaacaacctgggctgagagcataggtcagtgggagagtgcttgcatagcacattccagttttaaccccaccatcgctgaagtgactgtggtaacgccatcttgtcctgattttaccctgactccactttgttcaggtacctttttcagcccctaatcccctaaaaagtccaacccaccttgacagcatatttggaactttctaaggccctgaccacagcacaggtgaataatcaacctaacagctgaatgtataatcaagagaaacgttaccaggtttccccggacccatgcctgccaatgacatcattgcagtttttgcctttacaaatgcagtacctttgagcttcagtgctcttcagagcaggagtctgcactctgttccaagctaataaaggactctaatttggtcttacattcatagtactttgaaactttcttgcttgggctataactgcaaaataaattttccataccaacagttgaaagaagaaacacaatcataccaacagatacatttttaaaaatccaatatttatttattatctatgtgtatgcattattttgtgtgtatatgtgttcataagtatgtacatgtgtgtgtgtgtgtgtgtgtgtggagttcagagagtgatgttgtgtcatttccaatcactctcaatgttagtttttgggacaaggtctcaaagaacttagagtccattatttggctaggctggctggccagcgagctacagtaatccacttgtgcctgataccctcactcaactggagtcacaattgcctgtcaccatgcccagtgttgatgtactcaagtgttcctgatcctgctccaagcacattacaacagagccatttccccagcgccctcccaatcaatgttcttccatgataaaaactgtcagtggacaaggctagagagatggttcagtgatcagtatcgattcctggtcttgcagaggactgggtttcagctcccagcagtcatatccagtagctataactgatgctgaaggtcctctgctacacattcatcatcttgctactgaggtactataggcgcgatgctttttctgtggttatataaatgaaactttataaaatttaatttataaaaaaaattcaaaattcaatttctagtggtttgttgctaatatattagctcactaattttgacttgagaaagaatcttatctaacccagactggcaccaaactcacaagttagctgaatctagtcttgaactccttcatgatcctcctgcttctatctctgaagtattattaactccaattacaggggctctgataccctctgctctctataggctcctccatgcatgtaatgtatataaactcatgcaaacacacggaaatgtaactaaatacatcttttttaaaaattctcagctaggggctgagaaatggctcagtggttaagggcactggttgctcttccagaggatccaggttcaattcccagaaaccacatggtcgtttacaactgtctgtaactccagttccatgggatctgacaccctcacacagacatccatgcaggcaaaacaccaatgtatataaaataaaaataaattatatatatatatatattctcagctaataggaatagaaagaaatgctaccacaacaaagcatatgcacatacaaatcatagaaatgcttaaagtctgaaacttttctcttaagattatagtaaaacaagcccggcagtggtggcgcaagcctttaacccagcactcgggaggcagaggcaggcggatttctgagttcaaggccagcctggttgacagagtgagttccaggacagccagggatacacagagaaaccctgtcttgaattttaaaaaatcaaatcaagattataataaaacaaagaagacctttactgccagtctaaagcagtggtggttgctgttcatgtagtaatgttttaaagattgggggggggggggaaggggagacaggaaaaatattcagaagaatgatcaaaactgaagccacaaacactaagtagactatcccaaggaaacttaggtgccatggctaatctctacaaggactccctgcctcaaaagaaaataaaaactgtaagggcttagaatgtagctcagtgggagagtactgcctaccatgttccattgtgagttccatccctaatactggggagggggtgtttagaaaaaaagaaaaccaaaagaatatacaaaaggataacatatcaacagtagattgtttcaccaaactggtactatccaaggccagtaataaaaatcagtgtggaaaccgggcagtgtggaaaccaggcgcacgcctgcaatcccagcacttgggaggcagaggcaggtggatttctgagttcgaggccagcctggtctacagagtgagttccaggacaaccagggttacacagaaaaaccttgtctcaaaaaaaccaaaaccaaaaccaaaaaccaaccaaccaaacaaacaaacaaacaaaatcactgtgaaagctgtgtggagcacatctgtaatcctagcacttgggaaatgaagactggagggaggatcaggagttcaaggaaaggctcagctacctggggagtttggggccagcctgagttacagaagatcctatctcaaaataagacaaaaatcaatgtgctaatatgctaaaaataaaccagtataaactggaaatttgtaaagtcttgcttatataacagtaggggggaaagtcactattaaagttctacaacagcaaagtgataaatgtataacaaactactatatgcggaaaactaaaacaaagcaaagcaaagctaaaggggccttaatggaatgtgatgcccccagactgacctacagatgaaaagcaatccaaaactcctagcaaaaaatttatggacactaacttactgtgtcaaaaatttatagatgatttctgctttacagtacagaatgctcagagcttgaaaactcattctagcctggcatgctggtacatacctttagccccagcactcgggaggcagaggcagaggcacaggcaggcagaaacactgtgagtctgaggccagcctggtctacatagtaagttccagaacagccaaggctatgtagtgagaccttgtctcaaagaaataaacaaataatgataaagcaagcaaacaaagagcctgggcacagggagagcgatgccatggagagtccaaaaattcttcataatctctcacgatgaacatcggagaaaaatcccatatgcttaggagggtgcaaccaccttcaaatatattcagccatttcaaaatacataagagtgttctgtactgaacaaggctcctgcttaaaaaaataaactgctttgtcaaggactaaaggagatgggaaaggggacagacatatctgggtacccaattccagcctgaagtttccaacccacagctctctcgtcatcacatctcacttacatggagggggagagataattaggagggtgggcaattgtacttcacaacccaggagcacacaagcagtaaaagacagaataaccagggacattcagaacatgtcaaatcaccacgtatcttactaccacagccctacaggcctatgtactgtagttccttttactggctacatcatacttgactttcaaaaaaacctgagaaatgagggggggagacagacagagagagagagagagagagagagagagagagagagagagaatacaaagcacatgccctttaactgtcaaattgacacagtctacagtcatctgagagactgatcaaatcacactggcctgatgggtgccatcattccctgggtgagtggttccgggatgtataagcaagctagtacgcacaggtgagccagcaagccgtattcctccatggtttcttcttcaagtccctgcttgagtttctgctctgacttccttcagtggtggattaatgatctggaagtacaagccaaataaatcctttcttcctctactttgcctttggtcagtgtgttatatgacaatagaaagaaaagtaaaacaaaacaataaagacaacacagtttaaaattaaaaaatccagcatgtattagtatcagacttaaatacgtactgaatgttggaattattaaactgaaatatttgcctgtttttcagtgtcagttcaatggctgaaagtcaattaatagccataagtttgatggatcaagtctgaagcagaaagattgggaattccaggccagcctaatccacatagcaagaccctgtctcaaaaacacaagaaagaaattgatatgaacacagtctcagagcccttggtgttacccgaagggtggagcagcaggatatttttctcctgagccttacaaaggtcatattgggggagtcacatgtccagtcacatactggagcctaacctgctgggtttcttgccttcaaatctccatagaacttaagtgatggtattgttacatctcagaaaggtcagattcatcactgatgtcctgataaccctctcgttgggaccacacatatggtcttttctcataattggctgactgactttcagtagctgaatcaaagtcctgaaccactgctgtgcagaaagatccatcggcacagtaacgttttttacacaagtggaaataacattctaaatttgagtctcgggcgctatattgtttactcttcaaaagtaccatcagtgtcccaaagaatatagcattcccaagattcaaatatgtgacttcctttgcctgcatgcagaaccatttaaagtgacttatagtgtagccgcccgcgtaatgccctgttcaaagcttcctttgtttatgcagtggcaacagttgccctgtatctataattaataaagattaattgctaatatggactattctggtcttagtaagatcctatgcaaatagaaattattacttttagttttgtttttatttattaaaattttaaatgagatttatttcattttgtgtttgtgcatcacgtgtctggtacccaaggaggtcagaagaggatttggaccacctgggacttgagttacaaaatattgagaactcccatgcaagataccagccatgttagatcctcatgtcacaaaaaaattaagtggagaagctgagcttataatcctagctatttgggaggcagaggcagaaaaatcaagaccagcctgggttattacacataaagtaagagagacaagctgggcatggtggtacaagcttgtaatcccaaagcttggcagctagaaatgggtagtgagggtcgtggacagcctcaactacagaagacttcattaaggggctcaaaaagtgggcttacgaccgcctgtaactcgagttccacaggattctatggcttcttctggcttccataactgtactcatgtgcacattcctacacacacaattagaagcaaatcttaaagtgggaacagatctagatatagttcagtggtagtgtgactgtctagcaccacagtgtcctaggttccacaaccaatactggggggaaagggggaaataagcacaattactaaactaaaaatgatgcttaatctacgggatgacaaaagagtgagccgcaactgtggagaaatatggcaaaacgtcaactctaatattagggtttcattttattctctgtgtttgcatttgtgttaaataggtcataatatataaagctgccgaaatgttttaaaaatagcaaacattcctttgtcaccctcatacatatatgaaaaaaatgagatcatattatcctacaacttgtttttaatgtaacaagctatcatatcatcttttacaccaaagagccaaaatatacagacttttaaaacatcctcctattaatggatacacaggttgtttcttatcacttgccacaagaaaagagctgcatagacatcctcttttaggtatccttatttatatactgatgcttctctttctgaaggattgagccgtgaaagtcagactactgagttccagatattggaacttggtactccatatatatttttatttttctaaatatagctacatcaatgcttccaaatggttgcaacaattcatactttattcagcaatgcctagctaaggtactgaaatgtctttttgaccaagtaagcatctaacaaaagaacacagatcaccctataaggccctattataacagatgctcccagaccacaaatttagtaacatactctggtcctcatttggagtacataaaaagggcatagggcaaaaagcgttattataccataattaatgttaccaataagctagttttatcaactactaagtgttgatgagaaagaactgaggccgtttttcgaggcctctggggagctagaataaacactccattttggagacactcactatccgtcaaaccccaattagacaaaggaaaacaaaaggaaacctcaaaacacgatctctcctaggaatgagcctccccagcctgacaggttcatccgtggaggtccggtgatgtgggcactgatcactcatctattgtgggcggaataggggagaaatccggagtgccagccgccgactactcgtcccgctcggcagaccatgcggtcggagtggtgaccgctgcggcgggtcggcgtggtgaccgctacggcggccatctctctgacagcgcgagacccggcactcaccagggcatgttcattaattggccagtttctccactctccttattaagtcatcctctagctgcctggctaatcccgggaaggacgtatacatgtggacgccgccattttataagttacagaagcctggtggtgccgtgggggggggggggggggggtcgggcgggcggagagcatgcgtcacagccgaacagtccctgtgccgcgcggcgccgcgctgtcaggctgtccctaaatggctgctccagcaacgtgaccgggactgtccgcggtcgcttccgcagatgactgagcgcttgcggttcctctcccggctgcctctgttagcatctttcacgtgctcccgcgtttcttgcccgtctttaatttgttctcttgccaccccctcaccccccaccccccaccctacccccaccgaaattcctttttcttttttgtttctatagaagaccagcttgtgttttgctcccgagatctctttcggagccccttctgtgtttttagctgccagcattgctgtagctgctataactgcaatctacatgtcacagaggctaggtggcaaagtaaaccacaggcctgggtatgtcccctagtttttgataaagacagaattataccttgtcctattcctattggacacctcacagggccgaagctgacaataactcctttggcttttggatgttcacaccaatactggttaccacacaaattagaaaaggatcttgggttatcaataaaggcagagaactacacttccatttaaaaaagaaagaaaaaagttctcattttacctattgcaccacgaggcacaggggcagaagcgagtgctcagtggttaacagtgcttaatgctctagcaaaggatgcaggttcagtccccggcacatacttctctctacacagatctctctacacaggcaaacatgtatacacacacacacacacacacacacacacacacacacacacgaagtaaatgcatgtgtgtgtgtgtatttaagtaaaaccatgttggaaagttgccgaaggggcctcagtgaatatctgcttgaggaaggctttgctaaggcaacctgggacagctgtcatggagccgagggctgtcctctctccagaaggtagcacattttcccttacactggtttccctctttcccaagacagcaaagccctggcttcttttcattccattacaggcagttctttcctgtgcgagctctcctcagctgtagccagaatttgcctgtttggaatcctttcttcctcctagagtttctctgagatggcaagtttgtgaaaattattacacacacacacacacacacacacacacacccatggccaagacaatcaatttgatatgctcctgtgactataaccactttattgcccccccccatttaaatttttaatctagattcccttccccctctctccatgtgctcatggccagcctctagttctctactctctctttctctctctctgcctttccctgcctctgctaccctcttaactcccctccccatgccctgaataaactctattctatactaaaaaataaaattaatctaaatataattacatattctcccccattcccttctccaattcctcctatgttattcctcgccactacacacacacacacacacacacacacacacacacattgcctctcaaatttctggctttttgtatatatgtgatttttctctgggtgcgtatttggtttctacttatctttgttgttgaacaccccaaaagcagggctggagagttggcttggtgtgtaagagtacttaatattctcacaaaggactggggttcaatgcctagcagctgcatgaggcttctcacctcctctgacaccatgctcgagtgtggtacacagacctatatgcaggcaaaacactcacacacataaaaattctaaaaaaaaaaaagtttttataaacttaaaaaaaacaaaagtcaaatataaaagttgattcagggtatctgggagcccaactgtctgcatttccaacttcattctaatgtctgtggcaaaactgttgaaagaagtacctaggaaagtgtgactctagctaatttttaaagatttggcttttcaggcatgcatatcgttgttgctcttctgtttttgagacagggcccccgttattccaggctggcctcgacttattacgtagcagagaatgactgtaaattcccaattctccttccttccccgggcctcactttatcttctacaaacttcttgtgacatactcaggcctttggcaatagactaaaactttctggttttttccctcatcacccctttttgtccatatgggaacaatcttttagttttaggataaaaaccttatactctattctcatctaaaagtatttccttaatttcctttaattttctttatataaatgacctataacttcttacaatattttacatttatttatttttgtgtttgagaaagaccaaggcggggtagaagaagggagagagagagagagagagagagagagagagagagagagagagagagagagagagaatatatggatgtgtccaccacatagtttccaaggatggagctcagggtgtctgccaggctttgaggtaagctccttatcagctgagccatcttgcagtcaagactcagcccgtgtgtgtgtgtgtgtgtgtgtgtgtgtgtgtgtgtgtgtgtgtgttactaaggactgaatccatgattttctaattacatgctaagccattgctctaccactgagccatattgccagccccaagaaaaatgtttttctttctttctttattggtatctcaagatagagtttctctgtgtagccctggctgtcctgaagcttgctctgtagaccagactgggaatcagaaatcctcctgactctgcctactgaatggtgggattaaataaaactattctttaatattctaaatgaaaatcaaagaaaagctgagcaaagtggtgcttgcctaaaattccagaatttgagagagttaggaaggagcatcaggagttcagctcatcttcagcaacacagtaagttccagatcagcctgaattacatgagaccacgtgaaagaggggtggagagcaaagccaaagcaaaccatgaggctgtatatgaaacataggaaacaacatgctatcagtctttgaaacagtcctgtgttttcttacaatttaagttgcactgttgttagaaatttatgtcctgttagaacaggttttcagaaagtgcttttgctaaaggtattgatggcctacttggcttcacaaggtaaccaaccacaggattaaagacttgagtctctgccttcattttgagtctgtctttccgttcatttcaaactcctgcttgactgtgcataggcatattaataacagaaggagtgtcttcctaaattatttcattcatccttagtcatgttgaactccaagagcaaaacctcccaggacagaccttcttccatatgagggcagttatccatgatgcaaggcaaaagtaatcagcttatgcttcaaacatgagccaccctttaaaaaaacaagaactctctcaagacatagtatggtctcaagctcaaagcaattcttctgctgggattataggcatgtgctaccatggccagtcaagatgagggtttctctgggctatcttgcagtaccacaagacacaataattagtcaggctacacctcgaagaaaattacttttttttcataatgagctacaatttatttatttattgaatttggagtattcctcgatatcatccttggcctaagattctttgccatagtccttaaccactacgcaacagcaaccgaccaccttccgtggtttcccctctcgatcgattctacagaggcctacccattcccctagtttcttgttgtcatcaacctttatcaggttgatttggtgctcagcacaaagtgcctccaccagcttgacatacatgggctcatcacagttggatgcgagcacacagagatgggcttggcgcttgtctaactaaggctttggcagcttcgagtatgccacgtgctaggccatcctggatgagggcggtcttgagcacctcttgtagagcagtgttgacgtccattacacctccagcagctatgccttcctcggccatggcggtggattatgggtgacgccgaatcttgaacgcacctgagcttctgcctccgcgcaaattggtggcggcaggggaaaaaagcgaaaattacttattatgggtactccttgttctctattgaaatgtctctcctatttttagtttaaatctcaatactccagcgataggggcagggtcgttgaacccttctatggctcttaccacttgaccacctttgtcatcaggttatgctactctaagttactccatgttatataaaacattattagctcgtgaggtcaaactgccagtggcctattctttaaagaaaactgaacctggatcgtctggaaaagcagcgaatcctcttaactgttgagccatctctccagccccccaaatgtattattatctactctttctgtttgtttgtgtttgttttcaaggcagggtttctctgtggccttggctatactggaactgcctcggtagactatgctggtctcaaactcagagatccatctgcctctaactcccaagtgctgggattaaaggtgtgcacctccactgctcacattccatgggtttatcttaatcacatctcttttattcatattgcaacctcaccagtaccctcagtaacgtcatttaaataaaacaaacaaacaaacctgggactagagacatacctcgatgcttacaaacatttgctactctttcagaaaatccaagtttgattctcagcactatcaggcagttgacaaccacctataacttccgctccaggggctttgctgctctcttctggtctttgagggcacacacagaccatatacataactaaagtcagaaataaaccttaaaaactcaatacttttcaatgatgtaatggggatctaaagagatggctcagaggttaagtatttgccataaaagcatgaggaccagagttcaagtccccaaggcgtgaacccatgtgaagccctcctataattgcagctatgaaaggctcaaacagggatccccagagcaagttgcctaacaagacgtgccatatcagtgagctctcggtttggctaagatcttgcctcagtaaacaaggtagaaaaatgattgaagacattaaacttaggcctatatattcacacacatatacatatgaacctatatacatgtgtatccacatctatggacaaaatgcatatacacacaaaaatggaaaaggcaagggtagagtgggaagatgaacaaatgttttctttgctctctcaaccttggttataaaatacttcctttaaataacagaaacttaaaaaaaaacaaatcaggtatatagctactactgctggacttcagtccatgcccctcccaatacccactcatatctttccttcatcttattcaataagcattcttaagttttctgtaatataaatcaagaatcacaacaatatataactagagagaactctgcggttctgaggattcctcaggttgcataattgtgaccatcaacttgcattgcctgctcctgtgccaagactataacaccggagtatgtaatccggagtatgagctgagaggggaaaaactgatgtggcaagtggaagaacagatatagaatctatgtatttatttacttatttatatataataaaacacttatacttatcacttatatctgtgaccggtagcacatgcttgtaagcacaacactttgtaggcaggaagttcaccataagttcaaggctagtttggtctacatagtgaattccaggtcagcttaaacagtccttggaataaaagaagccacagagatggcttagcagctaagaacacttgctgctacagcagaggcccacattaagttcacactcctctgagacccatccaccatggctctgcttcccaagtgctcgtattaatggaatggatcattacatcttctccaaaacattattatttgtatttacatttgattattacatgccaggagggttttgttttttgttttgtttggtttttttttttttttttttttttttttttttttttttggttataattggtactctataagcttcttgtatgtttataggcttctctttctttattcttttcttttttatgaatgaggcaatttattaacccagtattattttttctaatgcttcttgttggcagctgccacctgttcagcgatcctgtccagatgtgtttcctgtccctgaggtgttagcttgcggcccccatctcggcccttttccaccattttcagccctttcagggcttggaggacctggcaagccatactctcagagcctctgctgaagtggctgggcctaacaccgttcctctgccatccttcatagatcttggtcacggaaccaactcctgcactacagttgtgtacagaggtacaggtccggagttgtggaagcagctcgtgggtagaaccagttctcatcatatggggcaagctctttatgtttggctaacttgactgtgtccacccattcccgaactttcagcttcctggactttttgaggaaggctgccagcgctctgacgaacctgatggttaacatcttttacagtgacttcaggcatcgttcagcctccatgctgccagccaggggaaagggtggcatctctttaggttgggaaaattttcttctgattttgttgatatttttccgggacttggagctggggactcttcactttctattactataacttataagttggtatgcctgttttatgaggtgctggagattgttttttgttatcttatataaagtctgtgaagttgcacatgaaagcctgatctttagatcccttagcactgaaattacaggcagtaaagatttgtctagtgtgagtgtaaatcttgaactttggtcatctggaatattaagcatctcaagagtaatctaagagcagtcttaagcaccataattgatcacttcttaggtctggggactaaagacatgcaccacgtccacctggttgaccacactttaagagatagcattgtaaaggggctttctaatattttctagggttaaagtctattgtcttcatggtagggagcatgtcagcattcaagaagacatagtactggagtttgacatctggttccacaggtagtaggaagaaagccaaccaccggccctggcttgggcttctgaaacctcaaagcccactccctagtgacttatgtccttcctaattcttctaaagtagtgccacctcctccccgctcctgatggcttagtgataaaatgtctgaggctgtaggagtcattgttcttacatgatctttggtagattgatttctgtatagggtgagatagtaccactatgctaaggatcacttggccaagtgactgtatgtctcttacatgtggtgtttgtacctttgttgagtagtggatggctgtctccaggtcctctattctatcccactaatttacaagcctacctatgagcagtagcatgttgacgctgtggtgcaacctgttcattcatttgaagctttgtcatgtagctcaatctggtctccaattctctatgtggctatttctgatcatccttgtaactcccaagggctgggattcacaggcataagctacttaccatgtcacctatttttaaaaactatttatgtgaatgtcattagaattttgctgagtatagcgctaaatccatagatgggtttttgatgcaacttagacaatattatgttgattcatgaacttgggagtgtttcttcaaccattttataccagatcaacccctctcccaatatacgttagaattgaaaaaaatatagatttcctggagagactggatgcctgatctacctatagttgtggctccaactttctctctgttcacagagccagtagtgtcattgaacatcccttcctttaaaaaaacaaaccatttttcatgatttattttgatcatttttccttcctccaactcttccccactcatccaaatccatattcattttcttaaaaacaaaacgaaaactgcgctgttttgtctggatggtgttttcttggagtcatttactgcagtctttctgactccttatcttcatagatgcctgagcattgaaagaaagggcttgatgaagacatctcatctaggaccaagtgttctaaagtctcttactctctgcacattggaagaccatttcttaactcccatttctgtttcttgctgctttgtagtgggtccttgtttcttgacccattatcatcatcatcttgttcttccttcttctcctctttgaatttgcatggagaattcctcaagattactattttaccccaggtgcatttttaatcttaatgttaagaatatgcaatgaggcaggcagtggtggcacacacctttaatcccagcacttgggaggtggaggcaggtggatttctaacttcgaggccagcctggtctacagagtgagttccaggacatctggggctatacagagaaaacctgccttgaaaaacaaaacaaacaaacaaacaaagaatatgcaataaattacctagttaagtgtacaggaatggaggtgttttttagaaaaatatttatttaatgtgagtacactgtcggtcactgttcagatacatcagaagaggttagatatcggatcccactacagatgactgtgagccactacgaagttgttgagaattgaactcaggccctctggaagagcagtcagcactcctaaccactgagctatctctccagcccaggaactgagttttagcacatatcccttcatgctttcttgtgataagactaaaaagtgtccccgaaacctgacataccttgatgtacacggtgtgagaaagaatgatgaggtttgcaagaattgggactaagtaaaacacagagactaaatttaactctttaatttgatgattctctctagcatccccacaaaaatgatacactggcttgcataatctgtgaccagtacctcgcaagttctaaattctctttgtacagctcatttagaagttctcgtttatacaaagccatatccatcgtggagccaggtgctcttagctgtgaagagcccttccttgggtcttttttccctaatatgtcctatgtgacttctcactggtgatgcttttggtgtgcttgttactctgatcctgatcgctctgtcaactaaagttagacaaagtaacctttacttctcaattcagataggaatccttttgcactccaagtttggcttcagatgccttggaaagattcatgctgccacctgctggtttattcagtctgtgtgcatcatttatttacttgttaatttgtttttcttttgttgaaacagtttattttgtagcagatatttttccatccctacctgaaccacctcaatagtaagattagtgaattgctggcactttgatcgtccataagcaaaccaattttgtgtcctttattattcatgggacgcctaaagggaacttagaacagactgtgaattatttgtcagcgtgaatcaacgagacaacaatatcctttgattttctaatacccagggtgtctgatctctttcatgtggatattcatagtttgacagttaacaaaatttgacagttcttttaagttagcagtgtctctggggcgagtaagataccaatgagctattattccctcaggctttgctttggcatttaggaattatttttcattactgctagcgagtaacgtacttcagtgcgtttttgtcccaaggtatggagtcaccaggttcccagagaaagactaagatgccaatgacccaaaactatgagcgtaagcccaccaaatcggtcacaactaatactctgataatttaggaaccaaggagccattttgtgaggcatttctaccctttcctctcctcatctgaggtcgccaactaatgcagaagaacttctagtgtccaagacgcggagcgatacatggtttgtccaagtagaagatatattgaaattttgcatagacaggtgtgtgacctaatgtacattatttaatgtttatgtggaagttctacataaacgtttttagctgtaaaataggataatccttcattatcgcgcaaaataatgaaattcacgcgtcatgtcactgagcttacgtacctccatctttattcattttaatttttttataatatagttagacctaaaggtccaataagatgtcagaattgcaatctttgtggccactcctcttctggtctctccgccttcagcgccgcggatcagttaaaggcgtgcaacggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtgtagcaatggattataggacatttaggtcgtacaggaaaagatggcggctcaagttcttggtgcggtataacgcaaagggctttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacggatttgcttacttgttgaattcattttaattacctttagtgaattgttactttggagtccttaaagttttcaataatttttttggcagatgatactcaaattacttggcacttaaatgtactttctttcaaactcatccaccgagctactcttcaaatttttaagtcttataacacagatactgttaatgtaaagtgaacattatgactggatgtcaggagtatttgaggttctataccagttcaggctttgcttttgttgctattgttgatgctatattgactaatggttttacttgtcagcaagagccttgaattgtaatgctctgtgtcctctatcagacttactgttataatagtaatattaaggcctacatttcaactttctgtgtgttcttgcctttatggcatctagattctcctcaagactcagcaaatagtgctgctgctattgctgccccagccccaggcccagccccagcccctgccccagccccagccccagcccctgccccagccccagcccctgcccctgccccagcccctgccccagccccagccccagcccctacccctgcccctgcccctgccccacccaaccaacccaatccagtccagccctgccccagcccagtcctagccccaggcccagatactttcagacctatcccaagcccacttctacttagagaaattcgaatcttcattgattcagtgctaaaatgcagtgtccatcactcagcctataagactgagacagcccatctataccccctccatactgacttctagagtcatggaatttcacttaatgcatagaatcgtattgctaaaatgcagtgcccatcactcagcctataagactgagatagcccatctataccccctccatactgacttacagagtcatggagtttcacttaatgcatgcagtcctattgctaaaatgcagtgcccataactcagcctataagactgagatagcccatttataccccataccccctccatactgacttctagggtcatggaatttcacttaatacatagaatcgtattgctaaaatgcagtgtccatcactcagtctataagactgagatatccctatgtataccccatactccctccatactgacttccagagtcatagaatttcactttgcatacggtcctattgctaaaatgcagtgtccatcactcagtctataagactgagatatccctatgtataccccatactccctccatactgacttccagagtcatagaatttcactttgcatacggtcctattgctaaaatgcagtgcccatcactcagcctataagactgagatagcccatctataccccctccatactgacttccagagtcatggaatttcacttaatgcatgcagtcctattgctaaaatgcagtgcccatcactcagcctataagactgagatagcccatctataccccataccccctccatactgacttccagagtcatggaatttcacttaatgcatgcagtcctattgctaaaatgcagtgcccatcactcagcctataagactgagatagcccatctatacccactccatactgacttccagagtcatggaatttcacttaatgcatgcagtcctattgctaaaatgcagtgcccatcactcagcctataagactgagatagcccatctatacccactccatactgacttccagagtcatggagtttcacttaatgcatgcagtcctattgctaaaatgcagtgcccataactcagcctataagactgagatagcccatttataccccataccccctccatactgacttctagggtcatggaatttcacttaatgcatagaatcgtattgctaaaatgcagtgtccattactcagcctataagactgagatatccctatgtataccccataccccctccatactgacttccagagacatagaatttcactttgcatacggtcctattgctaaaatgcagtgcccatcactcagcctataagactgagatatccctatctataccctctaccccctccatactgacttccagagtcatggaatttcacataatgtatagatttctattgctaaaatgcagtgcccataactcagcctataagactgagatagcccatctataccccctccatactgagttccagagtcatggaatttcacttaatgcatagaatcgtattgctaaaatgcagtgcccatcactcagcctataagactgagcccatctataccccataccccctccatactgacttccagagtcatggaatttcactttgcatacagtcctactttacttgtccatggacaagtaaacaaagaactcttgtccttcatgttaatcaagatacaccaatcaaacaagagttttatatcagagacttgccatggaggtatcatctctcaagtctcctttcctttaaggaaagaaaaccattctgtcattgctgtagtagtcacagtcccaagtttctaagcagtgttcagtcgtcttttctcatgtattaccttgagtactgaataattctgtcagaaatattttgtccattggattagactttagctagtccagccctgtgtgcatttagcaaaggggcaaacacaggtctgttatcagacagttaaagtgctcagtcccaattttcaaggcattggccattaaagggggtagaatactatatactgttggcatgctgtcatgggtgctatcgccccaggtcacatctttctaactgatggagatacatttatttgctcatgatattgtatactagtctcacatgctttcttatttcagccaaaaacctctgcactggaacattttatgtggataatcctgactaggaattgagtcttttctcaaggtcctaatactacccttgctttatgtaaagagggtgctgattacttaatgcctcttacacaattgtgcaaaattgcagttgttcaagtccccttctgttagtaaccaagatcccataccctcataccctaatgggtgacaatcaagggtgccaaccaatgagaccacttctctgttctggtctttctgctgtgctggggaatcaaaccttgagtcttgtgtacgctagtaaagcactgtcatagagctacagccccaccgtgtggtggtttgagagaacagcctcttatgtagcctgggctgggcgggacttacaggcattgccacctgtaatgtaaacatatttgtgcctgttgtgtgcacagctgcatttgtccctcttcctaagcattggataaagaaaccaaactaagtcaagtcattttgttggtaatcaagaagacctttgatctgtcctgtttttaacttccaggctggcctggaacttagcatataacccaggctagccttgagctcaggatctagcctgcgtttaacaagtgttggcatatctggttcctaccactatgccctgcatgcagtctttcatattgtgaatgtgcatatgtcatttcactgtagtaatctgcatctggtgaagacttatttgtattgcagcagtatttaagatccttaacatagtaaatgtgcacagtgttaactctattgtacatattctcatgtccacagttgtgccttttagatcaggactcctgtacttagcaaagcaaagaggctcactaatataaagcttctttcatgagactatagattgaaacgattccaatacggtcaatggtccttcaaggtaagacttctgtctctgatcattcatatcctctttgctttatggaattatgtatgtgctgtgcacttgaaaccccttcctcaaactatttatgtacatactggcaattttagtaggatcaattttactcttaactttgaagtacagaagtggtgttgacctataaggtcccattttgtggcttgctaataataatgactgattgtagtaggccttttctgttcactacagaaggaaacctgaacagcgtaaaactgtaatggccataaacatgtaccttgcatattagtatgcatttactgcacacatctcattccatttggatacgatcctactctcaaacccttttgcagtacagcaagggtcactaatcttttggcttcttcatcttcctggacactggataaggctgtcccctcctttccactctttaatttccaggactattactttaaagacttaatatttgcataaaggatggggtttttaattgataacatgtcccttgaacattaatgtatataacagggacatgatccattcattttaataaaaatacttggccagttaatgtgtaaaattacacttatccacaaccttattacttttcggaccattgtatctcttgcactcctgcaagggataccgtttatctcccaaggtccctgctagtggaccattaatatacagtgaatcttcctttgtctttgccagtaaacaaaggccatactccttcgcctttcatttgcactatatcaggatatgctgatcaacaaggccgcattcttttggactgttatcatatattaaatgtatgcgtatgcactgccacctgctctgtgcacttgaaaggatcccactcacttccttagcaccttcagcaggaagtgataataagctcaagactttcatttggaaagttcacatgtctaagcacttctctaagaactactgtaccctcttctccgctttaaagcagaaagagggttgtacgaagtgctcttcatttggacttaagtgcattaatgcagttagttgtccatcattacctttggagttggattttacatccttgtactcttttgacaccagaggcatattaattatttctgagcacttctcttgtcaatattaatctgtacccttacacatatgacctgtgcggcagcaaaggttctgaaatgcctaccttttgactggggctgctgagtggtagtaactattagtaacctcagcatttggatgattactatgcaaaaatgtcaaggacctgtgtgctctctttgcataccatcaaggctactgagtcccagaattaattgctaagttatgcgtatttataactatgaatgtctggaatattttgtcccctttacattattgcagaggttgctgagcccccgaaactacccggtactgtcaatgagcacaggggctctgacgaatgacctgctctcttccttaaactgattttgggactcttaataggcacaatggcagttctggatggtttattttctactccaacttgagcaaatcccctgctagtttcccaatgatataataaagtacagcagtatgtacacccaacaatgacccggatttcgaccctttttgcattgctttaatatatacaatcctaaatagtcacaatctcacactttatagtgttccttttgcccggcctctagtttgtccattgaccacttttctgaatcactaattctcacaaacccatcattaaggaagagtttgtgccctttctcaattccatcatgccatcccttttgcctctttgtttgaacagtattgactgggcaaagcccttctcttgacttaaagtcaacaacaccagtttactcacttcatatggctacagtgtctcagttgccttctccttgctcccactgaacagagacacctcgaattcttacattattctgggtaatgttaattaccccaaacaccctatgtgtcattaataaattttggtgtatttatacactgaatagcaaaagcaggccaaaactaggtggatgagccttcaatctttaacttgcacttctaaattattccaattccaactgctggcacattctagggccaggaaccattcttgcctacctttattaatgctttattgtgcaaaatattgcaggcaagtagctcagggagttggattgccaccttttacttggggctttcctttacagtatgaactgaaaattgtcttcctgagaaggaagcttagcacttttctttccattcttcctccaggaaggagccaactgtctgcttaagaaactttaagcccgattttgtatattgctactgtacaggaccaactgccagaaaagttattgataattttattccttaagaaaggcatttggattgcaaggtggattgactgtgagatcattagcttttgtgaagtaaaaatagccatttgtgtcatgtttctgaagactaagcagtgtctcagtgtactgagggtgatgagtctgtggaaagatcagtgcaactattgcagaatgtttaagacaagtatctttgcttggtctttactacaagtttaacaaaacgaaaaagtcaatctttgtgtggcctttagtatgattaactttttggaagatgacctaagccttctaatcattatattttgtctgacattggtcaccagtccttgcttatttttaaaaggtgactggatggattaaatttgagaacatgtcaagtcgcctttgaaaattatataggccatcacatttaattaattcattctatccaccattaaactctggcaataatttgaagtagcttgaaaattcctaaagtgggaatttattttagagatgatagaacctgtttccccactttacattttaaaatatgtctgccaggatctaatcattcctttaaacgtacacttcaaagagagattttcctagtaagaaaagagctttctctagtgtgaagggtgctttgtagccgccgagtacttaggtcttttttgggagctattgtgtatgagtgtatgtatgtgtgtgtgtacatgcatgttgctgcgcgcagtcattcattcacatggtgctcagacaacaatgggagctggttcgtctatcttgtgggtcctggagatcaaagtgagatcatcaggcttggcagcaagtgcctttaccctccgcgtgccatcttgccatcccgctgctgagtgtttgatatgacattgctgatgaaaataatcatcacaacagcagttctcccagcattactgagaaatgatactatttttctgaggaggatgttcaagtaactcatccagtgcaggatcctgcttgaactactgctcctccgttacatcagactctggctgtttagactacagtaagtactaccttgttagctactaagctatctttttctcattcgagtttctttctgtgccacccactgaaaagtcaaagtgactaataagtcactagctcttctcagcttatccatacacaacacatagtatgccaacgaaattgtagaattaacacattgtgtacccaatcgccattatgctggggtacactaaaatgagaagcgatgatattttacaaaatttcttccgtgagatgattatgttatttaagacttaatgtaatataagcacacttgagatcattttaggaaatgtactgcctgtgtgaattgtttaagtattttaggaagtctactggggttgaaatttgacttcttaaagagggaagtgtgcttactttgccttgttggtccagacgactattagtaccatctggttggtttatctgaatgccatctgtttctatctacctcttggaagcatggaaagaatattaagagtgaaagactccatgcattatgcttagctgtacgccaagggtagcaagagatgagcttgtgtaggaattgggaatataaatttgataatttggttctttcaaccatttttactgcatttctgcccagaacagaccactggacggcactaacagcttagacagagaacttcatagcttacaatctttttttttttttttttttttttttttttttttacaaaagtgcaaagaaggataagttttatgaacaaattttactatggactactttatgtaccctccttgctcatttttctttttcattaattaatcaattaattttgttttgttctctgttttgttttgtgacagggattctctgtgtagtctggctatcctggaactcaaactcaagagatccgcccgcagagatccgcccgcctctgcctccagtttagagtgttgggattaagggtgggtgccacactggacccctgccagcacttttcaacagatactttcagttaaaacaacaaatacttgactcctgtgtagaaaatggtctagctgaaaaaacatccttgtccataacacttaacatttttttgcatttgccttttgtacgtgcaaatgaccctctagtactttaacccttttaagtccactgtaaattccttcgcagcaggtttcccccaactccaaaggcttagcattgtctggctctctaggtgataatacatctagaactattgagtcttttaggaaactaggaccattgttgtacaagtaactgcttcaaaaggaaacatttgcaaggaaaaaaagctttttgagatgctaaagaatgtgtttggtgcactaagacagttagctaaagcttcggtctcaccttagcaccattggctacccaccccagtacatgcaaagtgaccccccccccaggcttgcctaggcacctagagctttcagcctgcctcctatggacctaaatagagattaggactcagactccagttagtggcctggaggaagctggtactgctgctattcacagtaaacccactatcactgacagttccctattgaaatgatcaagttgtgtgagcaggcagatcattaatcagggccaattctgtcatggcaacctagtcctacatgacctccacggcactgtaaaatacacacttatttgtagtaggacatctggaacatgagcttgtctgtgattgaaatgtccattaggaggtgccatcacacaaaaccatctggaggccatctttggtccccataattgatggaatacaaagagttccccaaattagtgtcctgacccagccctcactgtcagtaatcatgtaatggaaagccaccaactcgccatcaccatcttcaggctgcctgaactgtatacattaagaatgagctttcagccgggcagtggtagctcgagcctttaatcccagcacttgggaggcagaggcaggcggatctctgagttcgaggccagcctggtctacagagtgagttccaggacagccagggctacacagagaaaccctgtcttgaaaaaaaaagaagaatgagctttcttccaagctgtccaatggcttgacccagacttaggagtttgtaaacaaagaaccctgtagaacaagtgaatttgagaatgtacaccttcattaagtggtgggaagtggaagtagtggattttgccagctgattttacaaagccctgtggcagaaccagaccaggtctttgtatgcatactgccatataacctagccactgtccaacctgtgccctctctcccagtccagtgaacctcttctgcctgccccttacttagtcctctggctcatcccaggggaagatggctctatttgtgtagtcataagaaagttttgttaattttaaataaaacaggaaaagagaaagctcacttaagacgagagctggagagatggttctgttagtcttccagaggtcctgagtacaattcccagcaaccacatggtggctcacaaccatctgtaatgacgtctgactccctcttctggcacacaggcatacatgcagatagagtactcaaatatacaaaaagggaaaagaaatgaaaggcctttgaaatgtagacatgctttcaattttaaaggctgttttcacatctcttaagaactaggggttccatgagaacatatcctcaccctgagttcttaccaccaattgaaaacgctgacatgtgcatatgaagattgtattgctagtaatcaaattatcatttgtagagtttagtataattatcatttgttttccagggatgaatttggagtctgttttgtgctcctgcctcaagaagaaggattgcctggatttagaggagtgaagagtgctggagagagcccaaaggtatttccgttacttggttgactgagatagtatcttcccttaaaggtctaatgtgtcaagttatacctcctaagtaaatacctcattattttcatgtggaattttcaacaatttttgtagtctaatgatagccttgtatttcttcacagggacaaacaatccctatgtgagactcaaggactgccagcagcctatacagctacattacatctcagcagaacttctcttcaagtcctcgctactctgaacaaaaagcttacaggccacatggagaaaaaaaggtactttggagaatttgctatttgggggtttctatctgatctccagttcatcagagaatgagggggcaagtcaataaagcactccccatctcctggtcccctggcatagtcagttagccaatgagatccttgccttatgatgaggccttgaaatcatccccaccatgttatgaccaatctgtaacatttctgctctgaaatgcctaaaaggtaggttatcagaggaatgaaggccagtttctgacaccctagtcttttgtacttgatagagtaagtagatatggctgttgtcacattctgtaggcctgtcataattctggtctctgaatatcctcaaactcagaggtccaatgctacaccagtttctagggacatatgcaccataagcactgagccaaacaatgctattcaccttgccagtgttctggcatggtattgtttaaagcacaaattaaaagaagaaaataatttaacccctttattcccagagtatttgaagtacaaggactttaacacaacctataatctaaaggatctctcattggtaggtgacagaataaaagccagaaagaacttggatggagcaattctcatgtctctaagttaacactaagatctacaaatgtgaagggttcactctccaagcccctccccatgatttaacacaactgctggttactacataatgagacaactttcccagtattcttgatttcaagaattggcttttctttcacctcttttccagatctccccccagaattgtgggcttgctgctttgcagtgctggcgacctattccctttgacgatccctaggtggagatggggcatgaggatcctccaggggaatagctcaccaccactgggcaacaggcctagcccagatttcagtgagacgctttcctgaacccagcaaggaagacaaaggctcaaagaatgccaccctacatcaaagtaggtaagttttctgcaacagtgtaataattttaactttgatcttgttttccattaaagtcagccttttacttgagatatatacataaattttatctttttcccacatctgggaaatgtaactaaacagtgcaaatgtttcttctaggagaaaagctgctgcaatagtggcactgaccttcgaggaagccattctgctctatttggttctctctccagaagctaggaaagctttgccagctgtttacatacttcaagatgcactgctaccctactcatgccatataatacacaagtgagtagcttatttacctacctagctatttacgagtacactgttgctgtcctcagacacaccagaagagagcaccagatctcattacagatggttgtgcgccaccatgtggttgctggggattgaactcaggacctctggaagagcaataggtgctcttaaccactgagccatcactaacattactgatgatgaatgcctctaactacaaatggaaacctggctggaattgatacagaagtatctatcattaggcagaatttaaagagccaggatgttctagtacttctttcctggcattcatacagcttcttttgttctttgtagtgccatctaccaaatattacccttccccaaagcagcacagaaaactgggtcttcagcgtgatcaagcaatgtgaacacacaaaaggaaggcagctttataaatgacccgaggatcaacatgcctgactgcagcatcttaaaagcaatagaatgaggtaagtcactagcattgcagtcttctgaggatttgcatttgctggaagatggtgctgggtggagagcatctaatgtgataatgtgaggcagggccatgtacacgatggaagatgaacaggctttcacgttatcaaatggcctcacagcagcaactcaaactattatctgcttaccagttatatcacaagaggaatttagcttctaggttttgttgttgttgttgtttgttttggcttggtgccctaccattcttacagacttaaacattgaaaagctttaaatagtttatttcttatctccatctgtgaagcagccattagacttgtgaaggatgtaaaaaccaagcccccccttttttttaatagaagaggagagtgaagctgacaattaaatatgcagtcgcttatagtgtttgctgcttacagaagcttttaatccatgtaacagaatgttgagatgttcattctgtgtttaaatgtaatattccctagatgtatgccctttggcaatttagttctgctaagacctgtctgtttgtgaaggtcaaatgaaatcatgaatggaaagtgttgagtacagagcctggcaaatatgccctggagttgcatgactaggccatttggaagagttgacgggtgtgtcctatggtcctatgttaaggaaaccttaagtttaacgttgatagcctggtacagtgtactaatggcaatttttttctttgcccttccctgtttcttgttaccctctttctggtggtctttgcttactatcaatcattagtgtgtattgtgggtgtgtctatttcttgttttatgtatctattttttccttggtctgtgtgtctaattctttgttacatctatttcttccttgctttgtgtgtctatttcttccttgctttgtgtgtctatttcttccttgcattatgtctaattctttgttatatctatttcttccttgctttgtgtctatttcttccttgcagttgtgtctaattctttgttacatctatttcttccttgctttgtgtgtctatttcttccttgcattgtgtctaattctttgttatatctatttcttccttgctttgtgtgtctgtcttccttgctttgtgtctatttcttccttgcagttgtgtctaattctttgttacatctatttcttccttgcttttgtgtgtctttctttcttgcttttgtgtgtctatttcttccttgcagttgtgtctaattctttgttacatctatttcttccttgcttttgtgtgtctatttcttccttgcattgtgtctaattctttggtatatatatttcttcattgctttgtgtgtctatgtctccttgtgttgtctaattcgttgttgcatctatttcttccttgctttgtgtgtctatttcttccttgctttgtgtgtctatgtcttccttgctttgtgtgtctatgtcttccttgttttgtgtatctacttcttccttgtgtgtctaattctttgttacatctatttcttccttcctttgcatgtctccttctttcctttgtgtgtcttttctgtctgcagtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgcagtcacaccttgagactacagctctcactttagctgggaaaaacatcaaggtgtagaggaggcaagttaaataaaaagttgctcccctcctcatgggcatgcttggtagagtggaaataataaaagaggttctctatttcctcggttccacacattgcagaagatgctactggatgctaagtgcaacacatttgttccaaaagggcactcagtgtgacttacagatgccccggaaagcagagggatgctctttattaaacagaaatattagctcaaacgttttctagactgaagaacactttcctcatttcccacagtttgcctcagaggttgaatacaggaaggttattattcattcatttgctttattggttcgcctgttctacaaggatttgcatgtctcttaggccttcacttggctcctgagacatggaaaaaggaaacatagacatagggaagtgctggatggggggggggggtctcttttctgggtagtggcacgacttagtccttagtccccaagtaatatgcaatgtgagtcctcatcctcatgtcttctccggccactgcaatgagtgggaagctgggctttgtagcaagcctgaccctaaagttacagaagccctccacgctaagaaactcaattttctaggccattttagctatgactgtgaccactactggtcaggagggatgacagccatctaagttccacaatcttaggctactttgcattatcctggggcaaacaagccatttttgagctgcagcaggctttgaaatacattgaccaattttgcctgtgttcgttaaaccttttacctttttacatgctaatgctcacagtaatttagaaatgttctccttactataatatactcaaggtggcttgctatggtaaaataatgccagtggatgaaaataacattaatgtttaacattcttgcataaaatttaagaataataaaattgacaacaatcagaaaactggaggaacgaaagaccaaattgaaagaacttgaaaaagattaaaaatgcctgtgctttgaccctttccatttttctttcactcacagagggtgggacaggaggccgagtgaaggaaagggtccagcctgtctatctggaatctaagttgggactttaatgcagttccacaaaattggtattaattcgctaaatgtttctgaaaatgtattttcatctaaatggctatcagctaagccttgagtcaaatgggaatgaaacagattaagtcaatgtgatctctttatccaagttgccttagagctgaagtcacaatttgctgtaaggaagcttattcattgtagcatacgcatactttcaaagtatctagactttacttagtaacccaatcaggacattcaggcaaaagaaaaggaacagagaagatggagccaggttgaagaggtctgggagttcaaacaaatttttttcattttcattaaaactcaattgggcatcaaaagtgttactaatattagcttttaattagtggaaattggctggattcagtaatatccctttgtatgggtaggaatgggcttacatttctggaatttgcaaaggaaaaaataactgaaagccttcctttcacagttactgccatcaatattgctaccaattaagcacatcctaccatcatctgctttgatcacataaatgaactgtgtaccaatctgttgttgaaagactggagtcatcttcccaccaactgtgaaaaaacacatggaaaacacctggactttgtgaacggatgcggaatacagaacttctgttgactcttgggtgttttgaagacttgaaaaaaaaaactgttgcttaccaacatgtcacaatgagtccgtgtgtgggtgggtggatgggtgggtgggtgggtgggtgggtggttgagtgggtggggtagtttgctgttaaataaaatgctttgttttgaaaacatcatgtgctgtatatgatattttccttaaattttatttaatgtgcatgagttttgtctatgcattaggtttgggtgttatacccgtgtaggccagcagagggtgtcggatcccaaggaaaccaagttacagacgccatcttgtgtgtagccggaatgtaattcagatcccctggaagagcagttagtgctcttaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtatcttaaccactgccacattccccttttcctttgcatggagccagaactaggctagcctccaagtccctaagtagccggaatgactctgagctcctgatcctcctgtgttagaattacaggcttgtaccactaagcctgcttttcagatgatagtttctaactcagtggcccttttatcataccagatacctcagttttaattccctatgtaatgaaattggttatgttgccctggccatctggctagcctgaagtccatgtagattaggctggccctaaatccatagagcactgtctgctactgactcaggagtgctcggattaaaggcctacaccaccaggcaggcctagccagttccttgggtaatttgaggtctcataacttagagcctaagttgttcaggagaaagattatgagaacacaaatctaataagatcacgagaagcaaaatattgaggctcaaaagtgggagtactggtaagatgaaatgaaaagaaagaacatggctgtcaagaagtccttgaatagagaaaggggcctctgatagttctaaaattcaaagtgacaaaattgcgtctaggagaaaagataaattctctcaggagagagtttgtactgttagacatggctctgcctagccattgctaaccagtagaagtgctccaacaaaaccgggccttcgtttccatccaatgaatgggccagaaaagcaacaacattttacctgaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtaaatcttaacatctttggaaaatagcattggcccaactccaagaagcccatgaaaccttaccatttattactggcaactaaaggattgggacacagggcactcaaacgtatccactgatgagtatttaatagttccaaactatgtctggggtgaactatgaaacactaaacaaaataaaactagcaaatatgacagagacattttgtaaggaataaggggtgctggccagggcgggagggaaattgaaagtggaagagtaagcagaatgcattctatatacctatgaaaaatttctaataaaaaaccctatttaaagccgggcgtggtggcgcacgcctttaatcccagcactccagaggcagaggcaggcggatttctgagttcgaggccagcctggtctacagagtgagttccaggacagccagggctacacagagaaaccctgtctcgaaaaaacaaaaacaaaacaaaagacctgtctgagctggagagatgatggctcaggttaagagcactggatgctcttccagaggtcctgagttcaaatcccagcaaccatatggtggctcacaaccacctgtaatgggatctgatgccctcttctggtgcgtctgaagtcagcaacagtgtacttatgtaaaacaaaatgttttaaaaaatagaaaggaagaaagagagagagagagagagagagatgctctcataaacaacgtggaaggccagatgcacacctgaagttgtcctctgactccattatgctctgtgcaaccctcacccacaaacgtgtacacacaccatccacattcatatacaatacgcatcacacaaaagaaggaaggaaggaacgaacgaaaaagagtcaagaggagggctgccagcatccttgccctgatggctagggtcgctgcacgggtcagcagcactggactccctcgtctgactgtcaccctggtcatttagaagccaaacactgcgattcttcaaaggcgggatctgggctaagtaaggatgtggctcagtggtagagggacagccagggcctcgaactcagaaatccgtctgcctctgcctccggagtgctggggattaaaggcgtgcgccaccacgcccggctttaaataggattttttattataaatttttcataggtattgaagaggcacacatgagccccttcatggtttgctagaataaatgctcttggtgatataacttggtttcctcagcctgggttcctcaactagaaacaggcagttaaggtccaaggcatgagttgtgagctgcccgggtcttccaggcaacctgcaagtgacaggttcttgctatgcatgggcatccttattccccctgggtgaggagctttggaaactcaggggcagggagactccttctgaggcttctggaaagagagaatagatgtgaggatcaggtagaagttcccagactgtccctgccatccaagagggaggcaggagctgggctgggtatgggtcacaaagccagcagctgctagcactgagggtccttgcctttctgtcccatggcccctctcccatctgcactgtggttgcagagcctgagccagcacttcccccgactggagaatgacagaggcagagtccactcctcccattccggggcgggaagccaccatgttgcacctgggcccagcagggcctgggaacacgaggagcccacggcacccaaagccctcccctcaacccaggtccttgcgcaaggtcaggagagggcaggcaagtggccattaaaactgccctcccggcacaatggcacagtgaggtgaagctggcacaagaataaagaagaggaagaaatagagctgtagatagaagagacagcaacgtgtaataacatggcgccttcaagggtcaggaagggctattctgcaagtaatctcaggttaattagttcctctgtgctttactcgaaccaaaatttgtctcctatcagggagagaaggtggagtggataagattaaactaagcacacacagagacaattgtttttgcttttgtttttctttcatttttgagtcagggtctcacattgcagtcctggctggcttggaagtctctggcatactgctggaaacccaagcactcaccctaaccaagcactcaccctaaccaagcatgcaccctaaccaagcactcaccctaaccaagcactcaccctaaccaagcactcaccctaaccaagcacacaccctaaccaagcacacaccctaaccaagcactcaccctaaccaagcacacactgtaaccaagcactcaccctaaccaagcactcaccctaaccaagcacacaccctaaccaagcactcaccctaaccaagcacaaactgtaaccaagcactcaccctaaccaagcactcaccctaaccaagcacacaccctaaccaagcacacaccgtaaccaagcactcaccctaaccaaacattcaccctaaccaagcactcaccctaaccaagcacaaaccctaaccaagcacacaccctaaccaagtacacaccctaaccaagtactcaccctaaccaagcacacaccctaaccaagcactcaccctaaccaagcactcaccctaaccaagcactcaccctaaccaagcacacaccctaaccaagcactcaccctaaccaagcacacaccctaaccaagtactcaccctaaccaagcacacaccctaaccaagcgctcaccctagccaagtactcaccctaaccaagtactcaccctaaccaagcactcaccctaaccaagcacacaccctaaccaagtactcaccctaaccaagcactcaccctaaccaagcatgcaccctaaccaagcactcaccctaaccaagcactcaccctaaccaagcactcaccctaaccaagcactcaccctaactaagcatgcaccctaaccaagcactcaccctaaccaagcatgcaccctaaccaagcacacactgtaaccaagcacacaccctaaccaagcactcaccctaaccaagcactcaccctaaccaagcactcaccctaaccgagcatgcaccctaaccaagcactcactctaaccaaacactcaccctaaccaagcatgcaccctaaccaagcactcactctaaccaaacactcaccctaaccaagcactcaccctaagctcagttccaatagaaagaataactaaaagaattctgtagacaagggagggctttctaggtttaaaattaatttactggtccctaaaaaacaaacaaacaaaggggctggagaaatggctcattggttaagaatgctggctgctcttccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgccattataacatcacatacacgtaagattttgttcctattcactcccattactctctttttttctccctctcacttttactgatccccttactctgctcacacacttctgatttctggtttcttctatagcatggatgaagggttatttacaggaacatggcagattcttaccgaagaaagtatccccccctcccaactccctcagcaaacaataactactaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcagatcccattagggctgatcttcaacaatcacacaatcacatattcttttttgtttgtttgtttgtttgtttgtttttttgagatagggtttctctgtgtagctctggctgtcctggaactcactctgtagaccaggctggcctcgaactcagaaatctgcctgcctctgcctcccgagtgctgggattaaaggcacgcccagccaatcacatattcttatgactcagagctaaaagtctgcacgaacagaaactagtcttaccaaagctgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcagcttggcctgtgagtaaatctgtgggacattttctcggttaacgatcgactgggggggggggcagtccacttaaaccatgtgggtggagccacccatggacaggtggtcctgggaggtatgaaaaagcaaagtgagcaagccatggggagcaagccaggaagctgtcctttgtggttcctgccctaatttctactgtgatgtggaagtacaagccagataaatcctttcctacccaatgtatttttggttagaatgttttatcacagtaatagaaagcaaactaaaaactaaaacatctttctaactttcatgccacagtttctttttcttcctttcttttttcttttctttcttttcttttcttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttaaattaaaaaagttgaacctaggtgtgttgtctcgtgcctgtaatgcccatgttcaggagagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacaggcagacacggtaacagcctcttcatgcatgcactagctcacacacatgagtgcgcgtacatcacaaacacaagcacacacaataaatacatttaaaagttttcttctttctttgtaagtgtgaaaattacaaattgtagaattttgatccagataagaggatcaggagtttgaggctagcctgggctacataagaccctgtttcaaaaaccaaactaaaccaaaacacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattccatgcttgtttacgaacaagacaagtaaaatttctcgagtctctgtctcttggaataggtctttccactgtaggtgggagggaaatgtttccgtctcccaagtgctggaatttaaaggtgtgggtctggttgaactcgttttttgtgtccttcagtggtcaggtgccccggctggtgggtggggtgggaggaggagtatctgtctctattgttcctggactgatcctgaagtgtaacggaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccgtcctgatctacagagagagagagttcaaggacaaccagggctatacagagaaaccctgtctctgggggggaaaaaaagcaaggaaaaaaggaaggaaggaaagaaagaaagaaatgaagagaaagaaaaaagactaataggtcccagagactcccatgacagtgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgttacatgctgccacggtcctccctgtcactgctgccattgggctatggcctggtgtctgtactcaaactgaaaacttgcaagctagcacacgtgctggcggagtgtggacgcacgggtacacgtgcgcacgcatgaacacacacacatgcacacacgcgtgcgcacagacacacacacacacacacacacacacacacacacacacacacacacacacattttgcgcatgcgtacagatatgtgcgtgcgcacacacatacaggcacacgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacgacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagtttgaagccagcctggaaaagatggccagattatgactgtttttctaaataataagtaaagaaataaagaaaaggagaataacaaccaagcatggtgataaattcgtgacctcatcttctatgtatatgatgtaaaagtcatgaagtaataacctcttacaatattcaagtagtagctttacttggaaagaaagattttaaaagaaattttattttttagacagtcaaaaatataattaagaagtatcgtatctgtgctaagcagacaatataaaattcgggaacaaagaacatatatctttatctgtttgcttatttttatttatttatttatttacttacttacttacttacttacctacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccatcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacaaagtgagttccaggacagccagggctacacagagaaaccctgtctcgaaaaaacaaaacaaaacaaagagtactgactgctcttctagaggtcctgagtccaattcccagcacctacatggtggcttacaaccatctataattccagttcttaggggacattgacaccttcttctggcttctgtggacactgcacagatatggtacctaggtatggcagccaaaacacccaagcacataaaataaagataaataaatatttttaaaaagggggatgggggtggacagatggctcagcggttaagagcattgactgctcttccagaggacctgaattcaattcccagcaaccacacaaccatctgtaatgggatctaatgccttcttctggtgtgtctgaagacagctacagtgtactcaggaaaaaaatagtttttttttttttaagaaagaaattcagatatctgctgtattgtactctttattactgccaggacaaaatgtccagaacgataattcaaaaatagcccactgacttttcacgtgctagaaggtagaaagtgatagcagatttcatgccatgcagatgatccctgtttccacagaggtgcttctctcacaagacagaagaaatggaagagcaaaagacacaaccaggagtgtacttttagctgttcttacaaggacagggacagtaatcgagtcatggaggcattaccaaatacatccaaaaaggccttatctttcttgttgtttttgttcggttggttttggttttgaggcaaggtttttcggtgtagttctggctatcctggaattctggagtcaggctgacctcgaactcacaaagatcctcctgactctacctcctgagtggtaggacaaaagccgtgcaccatctgatcaccctactcatgatgtgtgcatgcacacacactaataataacaagcaaaaaatatctttaaaaagtctaaaaccacaactttgagacagacattaggtagacatacttattccaaaagtcagaaataggaaagaagaaagggataaattacgccaaataagccccagacatggcagggcaagagttcgttctgtgtgcgcacgtgctccaaagtgtttcattacagttgctttcagagtcctgggtgaggggattatttgtaggagaatggactccctacaagtagttacacactcagatcttctctccctttctcaccaactatagaccccccagggaggggtggggtaacatcagctcctcccaataggggaaggttttgttggtgttgtgttgtgttgtgttgtgttgtgttgtttgagacagtctatcactatgtagcctgattggcctggaattcatcaggtagaccaggctggcatctaaatcagagattcacctgcctctgtattttgactgctgggattaaaggtatgtacaccaacatattcccctaagaggggatggatcccagggtctagatgccattgctctctctcccctctctctttataaatatagttttaagatttttacttgtatttatcagtacagggggtgggttgctggagtatgccagaagagagtattggatcgcttggagctagagttacagggaattttgagacatctggggactgaatataagtcccctgaggagcagcaccccaacatggtaatacttcatcttaaggctcaagagcaaactttggctccaagttctgcctctagacacacggagcgccatttgggttcacagggctctaagcttgcctcgctaggcacgctgacacagcacttcttgtcagtcggaaccagttgctggcacctctcccaagctgtttttgcatactggtggctctatagctctggcgtcataactgagagcagtgttttcatagctcttttgggcattgctctcattgggggtctattctctgggcaaaagtcgctaagcactgtgctggtagagactttatatcagccttcctctggttctctgcttggctctcaaaactcatggaggaatcctttgaaatctaggtgaagctagtcatgactccacagctcatacgtttggaggcagcagttccttgctaaattctactttgtgtgcattaatgtctcctaagcaagtctagtagaaaatcctttataatatcaattgtagtacttcaagtttcttccgcatcacggcatcggctgagtaacagtcccccagatagatggaacaatagaagattacaaagtgagaaaaggaaggaagtagaaaaactggtgtttacttggttccagctgttttctgattcaggaagaaaggggccgggcatactctacccatttatagtaagaagatttttttgttttggtgggtttttcgagacagggtttctctgtgtatccctggctgtcctggaactcactttgtagaccaggctggcctcgaactcagaaatctgcctgcctctgcctcccgagtgctgggattaaaggcatgcgccaccatgccaccacgcccggcttgtagtaaggagatttaactgtaccatgtaaggcaagagctcctcatgtcagagttcaaaaagtaaatgtgctgaaccatcacttggtttagaacagcttaagcccccagcccccactccaccccaaaccaacccttgactgtttaattgctgataaggaataaaagccctttcctataaaccactgtttgtttgtttgcaacgaaatcagagatttactatatggatatttaaaaattcagaatttgggggctagagagatggcttagaggttaagagcactggctgctcttccagaggtccagagaacccagtttcaattaccaacaaccacatacagatcacagctgtctgtaacttcagctctaagggatcctataccatcacacagatatggatgcaggcaaaaaagcatcaatgcacatggaataaaaataaataaaatttttaaaatttggaatttacaaataatgaagatccctcactggttcagccactcaccgaggtacctcactccagcaatttcccctcaccagacttattcatttttaaagtttagatgtttgaatatttattgtaaaacagcaagcacaatgatttctatttttataattggtgacgtgatctggaaaaatacttctaattggtaaggcaagagtgattgcaatgcactcttcatttttttctaacttcttaaagtatcttcttttttaaaattaaaactttattataggggctggagagatggctcagtggttaagagcactgactgctcttccagaggtcctgagttcaattcccaggaacctcatagtggctcacaaccatctgtaatgagatctgatgccctcttctggtgtgtctgaagacagctacagtgtacttagatataataaataaatctttaaaaaaaacctttactggaaggagttacagagacaaagtttggagctgatacaaaaggatggaacatctagagactgccatatccagggatccatcccataatcagcctccaaacgctgacaccattgcatacactagcaagattttgctagaaggaccctgatatagctgtctctagtgagacttcgcctgggcctagcaaacatataagtggatgctcacagtcagctattggatggatcacagggcctccaatggaggagctaaagaaagtacccaaggagctaaagggatctgcaaccctataggtggaacaacaatatgaactaaccagtaccccccagagctcgtgactctagctgcatatgtatcaaaagatggcctagtcggccatcactggaaagagaggcccattggacatgcaaactttatatgccccagtacaggggaacgccagggccaaaaagtgggagtggggggaagggtatgggggactttttggatagcattggaaatgtaaatgaggaaaatacctaattaaaaaaaaaaacggggcctagcaaacacagaagtggatgatcacagttagctattggatgggtcacacggcccccaatggaggagctagagaaattacccaaggagctaaagggaactgcaaccctatagatggaacaacattatgaactaaccactaccccggagctcttgactctagctgcatatgtatcaaaagatggcctagtcggccatcactgcaaagagaggcccattggacttgcaaactgtatatgccccagtacaggggaaccccagggccaaaacgggggagtgggtgggtagtggattggggggggtgggtatggcggacttttgggatagcattgaaaataaaaaaaaacctttactataaaaaaacttgcaaataaaaaattacccaccggagctaatgaccagatctttaatagttttgttttttatattgttatagtgtttgtgttctcagcacacttaacaaaagcaacagaaaatataagaaattaatctactcaactaaactaattaaagtttattttgagacaggatctcactatgtagtcctgaactggaactcactatgagcagctggcttttaatttaaagacccacaggtttttgcctcttttgcctctggagtgctgggattaaaggcatgagccagcagcatcccagactacattttaagaaagggaaaaaagctggtcgccgggcatggtggcgcacgcctttaatcccagcactcgggaggcagaggcaggtgaatttctgagttcgaggccagcctggtctacaaagtgagttccaggacagccagggctacacagagaagccttgtctctaaaaaccaactaaccaaccaaaccaaaaccaaaccaaaccaaaaaggaaaggaaaggaaaaaacgaggtaattagcataattagcatgacaaggaaggggtagtgagaaacagtgacacagaaacgcaaaggtttcaagcagaatttattggaagtttggcaagcaacaaacaccctagttggcctgtagatgactttagattgttttgcggtgattttcattttgaagaaggatttccaattttcaaaacagccaggctcaaattaagtattttccatttattttagcagtttggtatagatttgttttcggcttagtgtgtagagatgtttgtttgtttgtttgtttgtctgttttccatcaggacttcatttatgcatgagggcacaatggtagctgatggtgacacgtttctgcctgcctgcttaatcagttgggttcatggcaccatctgtggaagaaaggttttcaattattctctatttttcagtaatgcctccctcgtgaacatctttagaaaaggggccttccaaggtctaccaagtcttatcgattctctctctgtgttttgttgtttgggaggtttttctgtgtaatggccctggccgtcctggaacctcctttgtagaccaggcagactttgaactcagagagatctgcctgcctctatctcctgagcactggcattaaaggtgtgtgctaccgccatccagctgattgcttatattaaagggcaaacatcagtgtttcagctatattagatgcctacgtgaaaaggcagtatggggctggagatgcagctggttaagttgcatgctgtcaaacctgtgagggtgcatacgtgtaagagtacttgccaatacaagcaatgctaaacagttaaatgtctgtttccttctttacctatggatgttgtcattggtttgctttgtaaactatagttttgacgctgtgaaagacagaaggcactacagaaactacaaaatccttttcctttgtgtgaaatgtgaaagttttaagaaaacttataaagaaattgcactgatttgattactaaacgtcagttctacttaatgccaagcttagccaataactatttacctcacttctttccaggaaaatgttcatggtattttattattattttaaaaattatatgtctctgtgtcacatgagtgctatatctgcccagctcttgagctgtttaaggtttactgtaaatgataaaagttgtatgttgggctagagagatggctcagtagttaagagcactgactgctcttccaaaggtcctgagttcaaatcccagcaaccacatggtggcttgcaaccacccgtaatgagatctgacgcccttttctggtgcatctgaagacagctatagtatacttagatataataataaataaatctttttaaaaacagttgtgtgtcttttatttaatttatacaagtgctagtgcctacaggggtgataggaattgggtctcctggagatgaaattataggtgattgtgagcagcttgacacaggtgctggggatcaagcttgggtcctcctctgtaagagcaatatgagcttttaactactgagccacatggttttagttctttataggagacactgttttttgttgttgttgttgttcttgtttttccccctccgttctgccaagtcctggagagtgttcgagaccgtgggtctattctatattctcagagctcaattgttctggaaagtcagagcctaagaggtaggatctcagaagtaggactggctgtggattggctgctcagctcttccctagcttctactccttcactgtgattgtagcttcagggattctggctccaggggcagcagtacagtttagtgcgatctgaacattaggaccctataaacttgtactgcttcagatcctcccagttccttcaaggtctcatttcttttttttcttgataactattactcacaatctggttcctacaggtgaaaaccttatctactccccagggatctcagctgaaccagcctgctggggctcctccttggccagattcaagagccttggacttggtttgttaacaaaggggagaggaggggctgcttatctggggatgtctgagtgggaaaggacaccagggacagtccttgagctagagtcctcccttgtggccaaagtacagtgtaatctgtgggaacagtgaccatttgtgtctcttccttacccttgatgttctttgattgcctagaccatcctcggaatgggatagggtgccttctgtctcctggatactgggattgcatcatactcggcttttgtagtactaaggactctaaccaaggacctcattcatgcaaggcaagtactataactagtgagctacatcctgattatccctccattgtcttatttattatttggttagttatttatttggtagggtctcactatttagccctagcttgcctagaacttgttatgtagaccatgttggccttgaagtcacagatacttgtcagttgcctctctgagtgctggagtgctaggcttaaaggtgtgtaccctagacctggcttccagtgcctttaaattccctgtatgtatgtcaggctgcaaggatgaaatgtgtgacttcaataacaatccaaagggcaagaaagatacctgattcagtttcttccaggtcttggtcagcttgtgggttctgatcagtgaacatctccctagaatatatagtgtaatcaattgtcaataggctaaatccaacaacttagagagacatgaaaatcattcatgcacacacatgaaaatatgacccatttatatttgaactaagacaggctatctacccccaccttctttgagacaggctcttactatatagtcctaaccagcctagaagccactatgtaaatcatgctctacgtagctctcaaaaagaaatctggaagtggcaatgtggtgaggtagagacggtgatggagagctcaaggccagcctttatcccaccagcagtctgggaggcagaggcaaatggaagctactatgtggagcaagttggcctagaactcctgcttctgcctcccaagtgctagaatgaaaggtgtgcactatcttacctgactatttttccattttaaaggaaaaaagacatcaaatgtgagcctccccctgccagagcctgacaaatacagagatggatgcttgaagccaactattggactaagcacagggtccccaatggaggagctaaagaaaggactgaagaagttgaaggggtttgcaaccccacaggaagaacaatatgaaccaaccccaagagctcccagggactaagtcatcaacaaagagtacacatggctccagctgcatacattgcagaggatggccttgtcatgcatcaatgggaggaggggcgcttggtcctatgaaagcttgatagatgccccagtgtaggggaattgagggtgggaaggtgggagtgggtgggtgggtgggtggaggaacatcctcatagaagcaggggagggaggatgggataaagggtttcgggggggagatgtggaaaggggatataacatttgaaatgtaaataaagaaaatatccaataaaaggaaaaaggaaaaaaaagaagaaaaaatgtaagcctccactagcacatgacaaatgacagtactgaaaggacagagcatgaaagttcttctctaggacattgcttgtactcaagagcagtcacatgaatacaaatagacttagggtctcttttactctttgaactctctgacttcctacaaaaatgagagccaggcccacaaaaacaaaatcctacataatttcataccaaaatcatctgtgagaaaaggtacacacaaaacagagtagacaaaaacaatctatcccataaaggaacagcagcatattgcaactgatgtgtggaactacagaccagatcactacaacactatgtcattacagacttcatcatcttcctacgttgcttctcaactgataccaaggataagactaagcacagttaatggataaccaactcctattgtatttctcctccctggatttcccataacccaagaacaattgagaatacatacatatacatggaggggcttgctttaatgttgccagtgatgactttcacattattgtctatgtctctgtcactgtgactggtttcatcatcttcagtacatccctatggagtgataaagacacaggggaaagtcaaaattgaagtagataatttttggctgtcaaaggaggacttttgtcttaatgttaaccctagagttgatagtcttaactgatgagaataaagttgggacaaagcttagtaaacagttgtaccttatggactactgcttctctcccacatcaagatcattagtgtagataccttgataagttttgagaaaatgggccttgggtacagtgttcttataatggtagattgctcacattaatgaaagcaccagataccctgaagaagtttgacttggttctagaatattttagtggctttggttgctgactataatcctcaattggcttttattactgctcacatttattttctttctttcaaaatcccaaaaggaaatctgaatgtggcagtacacatctgcagtcccagtactgatgaggtagaggcaggactgagggctcgaagcccagtttttaatcccaccagccctcaggaggcagaggcaaccagatctctgtgagtttgagggccagcctagtctacagagtgagttgtacagtgagaccttgtttcagaaataaataaggaaagaaggaggagtggagaggattatatctgtctaggtctcattcaccttagctccccagggctagtgtcctggcttcagggtaggcaaatagcagctacttggaaagaatctttactttggaagtaaatcctcaattttcatgtattctatattagcaaatttgcaaatattttaattgccttttggtcatttcagacacgcacagagaggtgaacaatttgtcacctggtttcagctctcaaactttaagcacacatcctctacattgttcatctaatatcacaatttccacatttacattccttttgctggcaacctccaccccaaggcatagtgctaaaactctatgcggtgtgtctaagcacacaaggctgtattgatgctgtgtcttgttcaaattttaaagtgtgtgtgtgtgtgtgtgtgtgtgtgtaagagagagagaaagagggagagggacagagagagagagagagagagagagagagagattggctctcaccttctaccttctctgggacagggtaagtcttatttctgccatgctgcgtagttcaggctaactggcctacaaccttccagaccattctgtctctgcctctcacctcaccatagacattctaggatcacacattcaaggcaccacatctggcttttaaaaacactttttatgggctaaaataccttttcacagacacacactttagaaaatgatactaaaaatacacagtgcgccagaagctgaatgacacacaataaggtagaactgtcaccgctctttctgtatactgtgcttcaataattcggccaagaataaacttgctacgtgtgcagttacactttagtttattcatggtatatactaccaaggaaaattttgggggtatataattaaacacattatcagtttgtttggatttttaaaaagctcttctcgcatacataacattctgactgcatttcccctccttccagtcctcctagttctccacccccagcccagccccatgagctcccctctcccccagatttgtttggaaacttttaaagtgaggctttcgaaaatggatgcactatgggctggagagttagcagagcacttagtagttctcactgctattccagaaggcctgagcttaatttccatcacccacattgtacaactagctcacaagctctttttgtttttgttttttgtttgtttgtttctgtttttgtttttttgagacagggtttctctgtgtagccctggctgtcctggaactcactctgtagaccaggctggcctcgaactcagaaatctgcctgcctctgcctcccgagtgctgggattaaaggcatgcgccaccacacccagctgctcacaagctcttataactcctaactataggggatcttctgggaaacaattgaccatcaattaaatacaatcttagcgtgattcagttttcagtggacatcattatcattatcattatcattatcattatcattatcattatcattatcattatcctagtaccatatctattgcatcatgtttagagcttatccacccttgacatttgtgttttttcagagtcccatcttggtgtgtttctgtcttccttggaccacttacagcttggcaagtgtcctcatcatcggtactgctgactctgtcctcctgaagaatatcttgcaggtgaagaaattcggcagcgctagagaaaaatgtcataataataaatacactggagagtcatttatctcaatgacagactacatgcaattcagaaaccgacatactaatctgttgcttaaagtaaaatcaggggccaaataaatgattgaataactatgatttacttcagaaaaatgccttgaacaaaatctaaaagctgaagcgtgtcacctagagtaaccttttcattgtatagattaaagaactgaaatagtgaggtgaatctgttttttgactataactttgttgcacttctactggcttacttgatatatgtattttgttccccaaacactttccttttaaaagcttcagttttggaattttatcaagtttgttcttgttttttgtttgtttgtttggtttttggtttttcgagacagggtttctctgtatggtcttggctgtcctggaactcactttgtagaccaggctggcctcgaactcagaaatccgcctgtctctgcctcccaagtgctgggattaaaggcgtgcgccaccacgcccggtttgttttttgttcaggtcacaatcaccagcctaattttgattcccaatattcttttttttttttttttttttttttggagacagggtttctctgtatagccctggctgtcctggaactcactttgtagaccaggctggtctcgaactcagaaatctgcctgcctctgcctcctgagtgctgggattaaaggcatgcaccaccatcacccggcgattcccaatatttttaacagaaacagatttgttcctaacagtagtccctaaatgatttaactatattgcaatttgggccctggatcatccacagtggagaatgtgtgcttttcaaggcagtctagaccaagattctacaagtaggtgtggctgtgcttgtgttcctaccctctgttttcatgaaacaaataggctacattttctcctagagtttctgggagttccattatcagttctctgggacactgtgcctcattcactagtcttagcaactagaatgcttctggccttgggaacatcccccatgaaaactgagtacaaaagagaaattgatatctaccatgttcataacaagggtttcagaacactgtgggaaataaaagtccaaagaaaattttttagtcttactgcagtaacacttttttaaaaaactcacagcaacttaccagtttcaatccacaagaagactaaaggctcttttctttttttggggggggggagcgtcatagattcccggctactgctctaggatgtctcatggaagtgtacatttctgtgctgagcatcaaattgtgtggcaaggtcatgcaagatgtatttcttgttcacttgggtggaaatcagctgctgacaccaaaggtgaccattgctgatgtgaagaaagtgttgcacaacttacctcagtggctcatctgcctgatcgtcggtgtcatcatctgtgatcatgaaaaatcaaatgtgaaagtgcagctaggaagcaaagggtggtagaaaggaggggttgggatcaaaggcctcttgagcttaaactgctgggtgcaggagactgctacctgctcaatgatattgttgaagctaaatacaacagagatttttttgtttacaacctgtggaatagttagttggagattggaccctttaaacaagcaagaatataaaaagaaaaaaaaataaaagttgtcgtttactaccttttttagtgttttaaattttgtatttacacataccaaaaaaatagtattttcatttattgttttgactatttgtaagtaaacttggaaaaagatcccttcagcattatttagcactttttcaaacacattaggttcttgaaatgggtgaaggaaaatgagcttaaagggggatgcagaacaaaaaggtacctgagttcctcttcagaccgggcccactccagcactaaaggagagaacccgagctgctgagttcattcccatgaaggcttaactgttgggttttggttttggtttattttttgtttttggtttttaaagacctagactgtcaacacataaataaaaaccaaaatgacaacaacaacagaagcaaaaatatcaaggtgggggttgggggtggggttccaaggtgcaatacttgcccagagcagaggacggcccaggctggaatcccagaactgcgaaagaaacaagagagaataaaaaggcaaactgaggattaaaacatacacagactcaaatgcaaataaaacttgtgtttaatgtgttagaagtcaaagcactttgaaaatatcctcacatgtattccatgttttaggaggtataggagcaagaatatatagattttatgggctgttatggaggaagcttaaacaactttattgatattttgtttgtttggaggtagggtctcactgtatatagccctacctggcctggagttctctatgtagaacaggctagcctcagagttaaagaggtttccatacctatgccttccaaggggctagcattaaatgtatatgctaccatatctagctcactttctgtttcttgttttgttttgtttttctcaatgcagagtttctctgtgtagtcctggctctcttggaactcactctgtagaccaagatggccttgaatttagagatccacctgcctctgcctcctgagtactgagattaagggcacgcacctccactgcccggcttcccgcgtactttcttttatttttttttatatattttttattacatattttcctcaattacatttccaatgctatcccaaaagtcccccataccctcccccccccactcccctacccacccactccccctttttggccctggcgttcccgtgtactggggcatataaagtttgcctgtccaatgggcctctctttccagtgatggccgactaggccatcttttgatacatatgcagctagagtcacgagctctggggggtactggttagttcatattgttgttccacctatagggttgcagatccctttagctccttgggtactttctctagctcctctattgggagccctgaaaatgaatccaacgtatatgttaaatgtcttagtttataagttttttgttgttcttgagtaggtccttcagtttgatttaggagcaataccagataacccacattcgaggagaacgtagaaagaagatggtaactgcaggctcatactggaacattctaatctataaaagacaatcctttccaacagtctaccacctccaggtccacatggttaactaacactgatttaattcattcgcaaccgtctgtgtcattctggttgcctccagttaaagggaatctctggtttagtttgacagctttggagaaaactaaggatcctaggatgatattacttagatatcaagggagaggtggcatgagaaatgaaaaccctggggagacaggagatggtttcccctttgctcctggggaatttgaaagaaacagtgtccctggactcgtgcccagaggagtcactttcctctttccggtaactataaaaaagtaagtaggtttttacctttgaaaagccagttttcttcatcctcgaattctggcaagtccattgcactgcattctgcttcagaggtcttggggctttgcttttcagacatagctccgggattcggcttctgtggagggagaccttgttggtggagctgatacccaagtctaggtgggtgctgtgaataaaggcctgagggcttgggccagagcttcaagtttttatcacagctcgtgctggggtggggtcaagttgagggggcggagtctggagagcctcgggtattgggaatgggtagaaccagagaatgacacacctctgtagtatcctaaatgcctatcttccatggaggtcttagaaaacattgacctctacattttccttcagctagggtaaaagtattaaggaaatctctgtgatctagtgagtattggcatgaaggagtaggtcctgtgtacttctttttactgatcaggtattagatcttccaaccatggagcttgtccttcccaatctacccttccagtttccagcacttgtatagaataggagggtgggtgggatcagcaggcagtggtgtaggaaggggacagtggttgggaaccagtagatgggaggtgagacctagaggtgaggaaatgggccaggagcaggcagggagttctgcagaactgtagtataagagaatgtcattgtactttatacccctatcctctaagggcatggaaaaaaactggagtctgacttttctctctgctggggtggaaaagcttaacagtatctgagcgaaggctgggctgtaggagccattcttatacccttcctttcagtgtgtcagatactgggattcccagagcttgactttatctatcaacaggcacagactgttagttcccagcagtattcaaggagcacagatggtgggggtgggcatgaggctggaaccagcgccatgacaggtggggctcgtggcagaagctatggggttatgtggggtaagatggtgatgggcagagaggtgggacacgaactagaaagtagcacactttggtagtacctaccctaaatgtgcttcctcattagagggcttagaacaaacacactcgctgctaggttgcggctctatgggaagcagcaagaaaatgtctgatctagtttaaagccttggaggtgggctgccctatgttcttcctttggatgcattaaatattgagacctcctaccttacaaagccagcaagaactcactgcacaactggactcgattttccagtggatctgtaatgagcaccagactttcaaacagtccttgtggagtacttaaggtgggggaatgaacgacagggcatggtgcgtggtggtgcacaggtctggggggccagaaagtgaggtggtgtgctggagttggggcagttcgacgttagaagagactgtcacacctttgtggcagcaggctaaaggctcatggctgctctctgagggatgatactagagaacagcgagtggcattgttctttcttcaactaccctagaagcacaagaaatggctgtgctctagagaatgttttcttgacacaaagtctcagtatgtagttctgctggacccaaattcgttatatatatcagattgtccccaactcacagagatccactagcctgcttctggcctcccctagtactgtcattaaaggagtgcactaccacactgtcctttggttgctattttgtgcagccatttctgtgcttttccttatattgggccaggtagtggactgccttatttataaagatagaagacctcactttggagcacgactctctttttcagagaccctgtacagtcctcatttagatttcccagcagtaattatggagcccagaagataggcttagggtcatctgggagaggagtaggggaggttagtatgggggaggttgggagtctaggaagagagaaaatctgatctttgtagtatcataatgttccatccacattggaacacttagaaaatactggctcctagattctctatcatctaggatggatacacaaaacaaatatctgtgatctagttaatgttagggaggagagggactggatcttcgttgggtccggtactagcttggctatcctcccaaacctacaacacagaccactcttctccaagtgtggcgacggtggtggggaggagcacgtcaagtgtgtgtgaaggggccaggtggggggtataggactagagaatgtcaagcctctaaagtatccgaagactcacattggtcggaggaccctgaaaacactgatgtacactctccctcacctagattggaaaagctaagaaaacaggactttttggtcattgttgttggggtgtggagatttgcatctatagtccttcttccactagatcaagtactgggcatctcttctttataaagatcttaaaaccttattggggatattgattgtcttcctaaaacaaacagaactaaaccaaacagaatgaagccaaggcacctaagctaaccttgacttaccttaccatttgattttgaagtagtgcttgagaaacacgaagtgggactagggtgcagtagagggagataggagggtggagctgggggagggggagggtagcacaggggttctagtggggtaagaatagaaaaagtcacatctctgtcacatcctgaaggttcgttgtggttggagagcctagaaaatactggtgtctaagttctctttcagttaggttggaactgtgaagaaaatgtctgggacccagttaatattgaggggttgaattgtccctatgttctcccaatcactgggttttataacagacttctttatgccttctacgggtgccaagacctcacttctgaccctggctttcctttccagggacaggcccagaccgttagatttcctagcactactcatgcagcatataaggtgggctgtgaattgggctggaggtggggatgtggatcaagagggtgcaggtagggatgtatgatgagagaatgacagccttctgtagtaccctaaaggcccagtgaatattctgtcacatcaccactgaaaattgaaaactatgctggtgcctagtctccccccagctaggatgaaaagctaagaaaatgtctgtgatctagttcatggctgtctgtatatgcatacatatacgttggtggggagagatctacctgttccttgctcttcctttcactgggctatggaggtgacccatagtgcctccagttctggtattggtcttcttaagttgaaacagttaccgagatcttactgaagaggttggctcttcctcccaactgactgtacagacctttagatctcccagttgtacttgccaagcccagaaggtttgtccccttggccttctggtatacagaatttgctctttctgacagttaaaaagcaagcaagcaagcatactgagctcgcttacattaacggcttgctccccacaggcatttctttcttttttggggagagggggtgtttccagacagggtttctctgtattagccctggctgtcctggaactcactttgtagaccaggctgtcctggaactcagaaacctgcctgcctctgcctcctgagtgctgggattaaaagtgtgcgccaccatgtccggcccccacaggcatttctgcagtctgttcctaggcagccatttctgcagtccttctgggttctagtttgctttctattgataagcggcttaagaataattttagggtttctagtgtgataaaacagtatgggtggggctggagagattgctcagtggttaagagcactgactgctcttcggaaggtcctgagttcaaatcccagcaaccacatggtggctcaaaaccatctgtaatgagatctgatgccctcttctggagtgtctaaagacagctacagtgtacttacatataataatagtagtaataatgataataggagttaaaaaaaacagtatgggtaacagtgacttgggggagaaatttcatttcagcttacaattctcaagttactctcagggagggaagtcagagtaagactcaaggcaaaaatctggaggcaggaactgaagcagaagccttggaggttgcttactggttgactcccttggtttgctcagcctgctttctgatggaacccaggagcacctggccagggagtcaaggcctactataggatgggccatcttatagcaaaatgggggtggggagtcctacagacttgcctacaggcaatctaatggaggaatttggtcaggtgaggatggctttagcctgttttttttttttttttttttttttttttttggttttttggtttttcgagacagggtttctctgtatagccctggctgtcctggaactcactctgtagaccaggctggcctcgaactcagaaattcacctgcctctgcctcccgagtgctgggattaaaggcatgcgccaccacgcccggctggctttagcctgttaagttaaaaactaaaacacaggagataagggtttttatttcatccctctaagtactttcaaacttccctctgaaacctcacaaaccaggccttcatcgcctgcatttctctcagcctccctacctcccaaggtcttaatggagtggtccattaagcagtgaccactcaacagcttttctagcccaacattccacactctatcacaaccctttccaaaatgcgggcaactctgtcacagcaacgaccatactggtacaagtttctattctagtttgctttctcttgctgtggtaaaatactgaccaaaaccaacttggggaggaaagggtttcttttaccttactgggtatagtccatcatgaagggcagccagggcagaatcttaaggctggagggagcctggatgcaggaagtaaagcagagaccacagagaaatgctgcttactggcttgcctaacttgcttttttgtacaatccagaaccccttgcccagaggtgatatagctcaggggacctcctacctgtcctagaggagcaagcaccatccacaatgaactaggtcctcccacatcaattattaaataagaaaatgccccagagattggcctacaggccaatctgatgggggaattttctcaaccgaggttcccttttcttagatgaccctgctgtgtgtcgggttggctagaaactgcccagtacatgccctccctttagtctttcttgagagctgagtgccttgccccaacatggcctctcactgctgctgctcctcaggaagaaagcttcctgcccccatttccctttagtctcttgttttttatgtttctgtctttgttgaaacagggtttcactatgtagcccttgctggtcaggaacctgctatgtagattaggctggcttcagactcaaagagatccacttcctgcttctgcctcctaaatgcatggattaaagatgtgcaccactatacctggccaaggttcttgtggggaaacacaatgggcacttaccttaatccaggacagtggcaggtgtgaagtggattacggtaccattactgtcttggggtcttgattgtgttcattctccaccaattaaagaattaaaaggcaggaagaagaactcaggcacactagacaacaatatttaacacactttattaaatatatgtgaagaagggcaccatacacacactcacacacacatatgagagagacagacagaggaggtggtggtggagggaggcacacatgaagaaaagaatccctgcagggccgagaagggatttggaaagccaaattcagtttttaaaatctggggctgggaagccgggtgtggtggcacacgcctttgatcccagcacttgggagacagaggcaggcggatttctgagttcgaggcctatttttttgccatctttattactgatctatgtggcctctttgcctatctatctgcctgtcagggaactacccaatttttagtccctaagcactgaccaagccttttagagcccaaagaccacacaacaattgagtttcaaatgcaaaacctttgcctacaggatttagatctatactgctagattttggtttggtttgattgttttgttttgtttctttttt

SEQ ID NO: 2 - DNA, 82845 bp, Homo sapien
caatttgtgatagatgaaaacagtgtattctaatattaggataaaaataatatgaaaggcccggagagatggccctacaggtaaaggcgtatggtacccttgaacacatataaaggtgaaaggagagaactgaccccagacacacagcacagcaatgcacacaaacactaataataacggtagtagtaataataataataataataataataataataataataataataaattaaacatcaaagaatgaaatctataacatttaaagaatattgtcatgaaaatgatggtacagtccacaaaatggggctttaaaaaagtctttgccaactgtacattcgacagaagattaacatcgacaggttctttataaagaaattaaacccttcaaaaccccacaaataattcagccagtaaatgaaactgaacacacacaagtggccaatatctgaaaatatgtccatcaccctaagccatcagggaaatgcaagtttgggagtacatttgagattgtggaaaggagataaagccaacaaggatgtagggaaagggaaacttttattttactggtacagtgactctggaagttggtatggagagtcttgaaacaattcaaagaagaattatcaagtcaggcatatgcgtgcaatcccagcacccaggaaacagaggtaggctgatttttgtgagtttgaggcatatatgtattcaaatgctgtaatgaaacccacttctttgtttgctaattaaaaaataataatttccaagcgacttcatgaatagggaggtagcaaaatgtatttataatattgttatatacgcaataatgtgaatattctgcttttgatactaaatcacagtttgcaaggctgtggtggtttgtgcttagaaggggaaggcaggatcatagaaattctgggagctcaaatttaaggccagccagggatactcaaaaccctgttcaaacaccaccaccagcaccaccactgctgccagcaccagcgccaccatcgacatcacagctgccgccgccaccattaacaccaccaccagaaaaaaagctaatgcatgctaattccatgaattattttattttacatgcaattgtgttaattccttaatacttggaagcaagttgtatgctattaaaaaataataataaactgaggagttgcctaagcaaaacaactcaaagtagaaatactgtataaagaagaacacattaatactctgtaagaaacatcaaagagtagaaaagacattccttgggtaccaaaaacaaagaaatcaaagctactatacggaagccaaggcaagaaatgtggccaaacaaacacaaaggggagtttaaggaggaagggctgcctgcgggaagccaagacatctatccaaaaagaaagtgattattcacagccacaatagcaccacaaaaaagggccttttcttatcactacctctgctgtgtactgaatttatcccagtccaagagatgaaaagatgctacctaccactacatcttgcctttccttagtatcctttttgttcactgacttttatctttttgcctaattacctatttttattagttaataataacaacaggaacaggagagaataattgagaatttcatgattttttaaataattttattcagactatacaattgaaaagtaagaattgcagtggtttttttttctttttctttttttttttttttggtctgttttgtttttagagacaaagttcctctgtttcgtcctggttgttgtggaactcactctttagactaggttggcctagaacttaattagtttaagaccataattacaaaggctttattgtttgtatgcaaagcaagttaggttccttctggatagtttgtggtatatattatcataaaagtttttattttaaacttatatatataaatatatctttaaggataatggtacctaagtattaaaaattcctataaccagtcatggtggagtaattcatcccagcactcagaaggcagagcaacttttcaatgtatagtctgaataaaattattaaaaaaaccatttgattctcaatttctcttgaaattttctcctgttcctggtccttttggcagataaggcatattttagacaaaacagtattattatgaagactagtcatagaacaaaggagttcagaaagacaaggttaaaaagtctatactgagcccgtgaggtggctcagtgagtcagggtgccggccatacaaacctaacagtcagatctgtatctctcacccaaaagctatgaggatgatgcgcaatgagatcggtatttccatgccacctaataacacagtagccatttctcagttgatgcttcaatgaaggaataatttaaattatcaagtttaattatgaattacatttctcttttgtcttcttttgcccctcctggggattgaacctaggacctccttcatgttggtaaaagcactctgccactgaatcacaaacattaacagtgtgtattacagtttgtgatccatgggaggagtgaggaaaatagcaacacagtggctttatggcaggagtgtagtgatagagcacttgcatagtgtgttccatcaacctttgccaggaaaactagtaaaattaaccggagattggaggaagctgattccaaccttgatgggtgatcttggggatgagccaagattttagtagaagaaataacctcagatgtagtgaaaatatcaaaaggtagaattgagaaaggagtctaaagctgttagttaattgttggtgttagagggatggctcagcagataagagcaccggctgtgcaagaagaggtcccaggttaggttctcagcacccacgtggcagctaacaactgcctggaactccagttccaggggatctgacacctttttccagcttctgaaagcataggcacacagatgcacacacacacactcagaaagagagaaacaaacaaataagcaaataaataaataaaaatgaatggatgaggagtttgctttcttatatgaaaaagaacgagtttcttgtgatggcttttaaatgttgtaaagatgctgtaaacactgcttccatccatcacaaagaattgaaaatattacattcacttggtagcacagtagcagtgcttgaaagcactaaatgcaattaaagttcaatcatagcactacggagaaatcaacagatgtagagagtcaacggatgcagcaagctatcttgttttatttcaacaaatttactcagctaccccatcattgagggggcagggatgtcaaaggaggcgccaagtcagaatgtccttcccaatggcacagtatgcatagtctaaggtaatgctttaggccagccacagaaagcaaagggtgttaatggtcctgtagtgagggggatgtgtactgcaagacggccccaagttgattgacattaccaaattgggttaaagggcgctttaaactttgtagtttgggctggtgcgggtgcttaaaaaaaaatcccaaatacattttgagataaagggacagctggaaaattctgcaggacaatgagcatagtgacttctgtggtgagtcactgctcagtggcttctaggccctgggtgcctgggaagctgctgagtgagtccttgcccacagctctctctgtttagggctttgctctctgaaaaggacacactcctcactaatgggacagaaggttttcagcctcttttgctttcagcttcttcgtttaggtaaaaggaacagagggacatattttatagaaaaggtggtgttaggggcgtaggtggcactgagatcattctggccacatcctgctgaattacaactcattattgggtggcagtctctgaatcagaggctggtatctgacttcacacatcagagggatagtgcttgtgtgttgcatggtggtttaggtaaatctggatagcacgtggagtagaaagggacctatggatataaaaatcaaaatggttattaacatggtaacagctcctataagcaagtcgattcaggatgagttctaaaaccatttgttccagaatttgataactacttccagtttttgttttgttttggtttttgttttgttttttttttttttttgttgttgttgttgtttgtttttttttttttggtttttttttttttggtttttcaagatagggtttctctgtatagccctggctgtcctggaactcactttgtagaccaggctggcctcgaactcagaaatccacctgcctctgcctcccgagtgctgggattaaaggcatgtgccaccatgcctggctccaggttttgaaatatggtcagctttgttgctgcaacctaacctagccagaatgacttacagaaaagctctgctgctttcccccaaagaggccaagtccccttttctctggccaagagatttaggcctcttctgttttggaggagtgactcctgccaagaaccctacctgataccagaccctttcttcgtttttacttttaaatacttattttatgcacatgagtgttttgcctgcatgcatgcataagtactgtgcatgagtgtctggtgcttgcacaggccagaagagtgagttgggtcccctagaacttactgcattggagttacaggcagttgttggtgctgggaaccaagattctctgggaaagcaacaagtgctcttaaccaactgcgcaggcccaatcctagattcttgttaaacactgagaaattgcatcaaggatttcctgtatggcttgcgataaggaatagtagtgtacaaagtacatagttcctgtgccaacatctgtcattaaccctaagattataaggaaagagtaggaaataatcacgtgtcttctattccacatgcaaccagtcaaagctctggttattgggagcaacatttatgttgggggctagggaataggtatagcagtggaaagtttcggtctagctgatgaggagacacaggtcaaggggaagaagccctgtttgaacagctggtgaggctaagggagagaaaacggagtaactgggagggtgccgattggggggggggggtttagatcattctaccaaactgaaagggtaagggtgccctcccatcaagtgttgaagtgtgatgctgtgaaagagacagggtaccacaaccttcaggatcaggtctgccacttggtggccttctccaggttagctggcctgcaagcttctgtctgattcttcctttttgttccgcccatctcactggagcaatactgggattatagatgtttcactgtgctccgggggacaaattcgggttgtctgagtagcactgcaagtgtttttactcagtggcccaactctctggtctggacctaggatcttgaactgggaggtctgagctgtctgcttttctgcaaactagcgtaggtgtactacaggaggagctggctggctggaggtcctacatcaaaacaaggtgagcgatgagacagactcctgaaagcacacacaccagggaaaattgtacaaactttaaatctttttctctcccttcccttcccttcccttcccttcccttcccttctcttttctttatagaaaatttattgcaactctccaaccgcacattactttttctcttcaacatcttgctccgcagcttccttcacgctttttgcttgggcattggcacaggccatgtgaagactggcaaaagccttagagttctcttctgtgtcgacgctggccttttcctttttgtacacattccgggtgggcatcacaggtcctgtcagttgggtggccaatttaagttcttcaacagaactgtctcccttcttcagagaaggcttcctgggggaaagtatgagctttgagcagtactcctttaggcgctgcatggtagcttgcagcgattcagtggatttgtttcgcctccttgggtccacagagatgccgatggtatgatttcttgtggttaccagtcaccctgagttcctccaggctgaagcccctgacagctcagaccttggtgtgtttttttttttgtttttgtttttgttttttcgagagagggtttctctgtgtagccctggctatcctggaactcactctgtagaccaggctggcctcgaactcagaaatccaccagcctctgcctcccaagtgctgggattaaaggcgtgcgccaccacggcccgacttggtgtggtatctaactgtagggcacttcacggtgggcctgaccggaccggatgcgggacgagtggcaatgcagcacgcttttgcctgccgagccctgagtctgcggatcttgcatggcagctggttgaaccaagtgtctactagctgctgccaatgtttgtggaagtggggcttcatgatcacgccattccggctggacgccatggctgcctcctgtacaggagaacgacagggcggagaggtcttccttctttctctatcctccctgacaaactttctctctctccctctccctccccccccccctctttggtttttcaagatagggtttctctgtgtagccctggctgtcctggaactcactttgtagaccaggctggccttgagctcagaaattcgcctgcttctgcctccctagtgctgggattaaaggcgtgcgccaccactgcctggcttgacaaactctcctgacacatggtatcatgtccttaagctggccttgaactcagtatgtagatgcttatgaccttgaacttctgatcctcatgcctctgtttcgtgctaggattacaggccagtgtccccaaacacgatttgagaatttattttcacagagatgcaatcatcatacaaccggtaaacggtgatctttcaacaaaagatggtgaaacaattgaccggatttcaaaacaaaacaaaacactcattcattatacaaatattcattctaatgaatactagatttaaaggtactaaagaaactttatatgacatctatggagaaaaaaaaaggaaaacttgtgcgttgtttggaaatggctttgaaggaacagtcctagttctagctggtaaatctggacttctccacatgcatcagcgaccaggagactattttacacacagagttaaatgcagaagtgactagacatttcaggaccagttttcctatggtcagaggaaagttaaaaaaacaaacaaacaaacaatactacctccattacagagtcctccgtgtattcatgtttattttcataaataacacagatagctacacactgagataattaaccaggcaccagcattactatatacatgtattttctaggttgctgcttagtccagaagcaatgaagcttcaccggttaaaggacactcaatactcacacaataccttctaaatctgtttttcaacaggaagtacccaggctcctcatagaaatggctagggatagacatagtgaaggcgaactacaaggtaagcatcactatcttagagtacacgaagcactggggaggtgatggcagcaagagccattctggactacataagaccctatcacacaggagaaaaaaagtagagattgtaaagggtaaattgataattaggggctggagagatggctcattgctgttccagaggacctgccttcattcccagcatccacatggcagctcacaatttcagttccagtggatctgaccacctcttcactaagacatcaagagaagtggctgggacatgtgttaacaagcacaagaatagtcgggcagtggtggagcaacgactttaatcccatcacttgggaggcagaagcagatggatttctgagttcaaggccatcgtggtctacagagtgagttccaggacagccaggactgcacagagaaaccctgtctcaaaacaccaaaccaaccaaccaaacaaacaaacaaacaaaagcaagcacaagaatcaaaagcataaaaaatgaggaaatttgttctcccttctgggattttcttcatttatgtgctcagggcacacagaaggttgaggagaacactgggaaatgacccacggaccacacattttaggcataaacagtgtggggagagttggaaaaaaaatccacacagaagcacacacacaaagaagccctacttagatcttcctctcctatacagaacaaaatccttattccatacaagaagggcaacaaatactacagcctctggccagttgtgaaagccatctgaccctggtgaatggacaggaaggggttaaataaaaacagttccggggaaaaggtagaaataaatactgtgtctaaatttgggaaagggagcagggggcaggagtagggagcaggaatccaccacacaatccaagactgagatataataaaccagcagatgaggcacactccctgccagtcacaaggctaaggagcactacagtacagcactacaacataaggcttactacagaagtaaagacagttacgtggaacaagagctctgagacacagcgcaaaaaccacctgagagtaatggagttatttaggaaaccagaggcaatggctccctgtcaaacaccctacaaagatgtatcactctgagaaaagcaagccgcagcttcatctccagagcagtggggcagaggcttaggccaggatgaaggaagacagagcccagaaagacatcctcaagaaaactgattaggaacacaatgggggaaggcaaaagcctaagagtggaaagcaacaaacaggaaattctaactggctgaaggtactaaactagtctaactcatcacttagtctgccttatgtgaaagctcactagtaggaagtgacagattgaataagagaaaaagcttgcaaattaaaggtagctatccacgagtctcatttaatttagaagcttacatgtaaccctattttccactggggagcaggaaagtggaggatgtttacactttaagtgggagtagtaaagtcgtttttatgagaattcaataaacttaagagaaacatagaatgggctaggactttctgttgagcctataaaccagtgagtggtactcgaactaccatagatgacaacccctttggcaaacctctatctccgaaaatatttacattgtgattcataatagtagcaaaactacagctatgaagtggcaatggaaataattttatggttgagaatcaccgcaacatgaggaactgcattaaagggccacgagcagcattaggaaggctgagaaccactgctctagacagacatctgcttgtgtactatttttatggaatttttatttttttctagacagggtttctctgtgtagccctggctgtcctggaactcactctgtagaccaaactggcctcgaactcagagatctgcctgcctctgcctcccaagtgctgggattaaaggcatgtgccaccactgcccggcttttatggactattaaatgaaacctaaggctaaggcagtgatgtagggagggcaaaggtgtatctaggaatatatagtttccaatttccccttgtggcacaaatcagtttaatgaaaacctaaggaaaagccagggatggcggtgcatgcactctgagttcagggacagcctggtctacagagtgagatccaggacagccagggctacactatctctaaggggaaaagaaaagaaaagaaaagaaaagaaaagaaaagaaaagaagggaaggggaaggggaaagggaaagggaaaggaaaagaagggaagggaagggaagagaagagaagagaagagaagagaagagaagagaagagaagagaagagaagagaagagaactcaagaaagagaatagaggtgattattatattcctcagcaggtctgagctgtataagcagaccaaagtatactttcctagtatcttctactctcatttgataaagcaagcataataaagcactgtgtttgggagtggccattcttggactccttcataggcttcaaacactacctttacaaaaggatacaaatttatttgagtgacattttagaacaacattaccaagagccatgggagagatgggggagatagttcaatgggcaaagtgcttgcatgaagacttgagttcagatcccaagcacatctttagaagctgagcatgacggcacagtgcagcactcatggatagaaacagatggctcccacaggcttgctggccagctccaggttcagtaagaaaccctgtgtatcagtcacttttctgatattgtgataaaacgtggccaaggcaacttagataaaaaaagagtttatttgggcttacagttccatgacagagtggaggtggcaggcagcaggcatggtagctggagcagccaagttgaacatcttgaactgcaagcataaggcagagacagtgaagtcaaaatggtgcaaatttttaaactctcaaagcctgcctccagtgacataattccatcaacaagactgtgcctccctagcctttccaaacaatggcagcaactagggaccaagtatcccaatgcctgagactatggtggatatctcgttcaaactaccacaccctatctcaaaaacataaggtaggttgactcagatcttccagaggatgtaggttcattcacagcacctataagacacctataaacaggtgttttacaactgtcaacagctccatcccaggggatccaggtccctcttcctgcctcccctgaacacctagcacacaagtggtatgcagacatatgtcagcactctggacgtagaggcaggtagatttctgtgagttctggggccagcatggtctacagagtaagtttcaggacagccaaggctacacagagagaccctgtctcaaagaaaacaattaaaactaaaaaacaaagtgaagcacaatagaggaagacacccaaagtcaacctctaatcacatgacgtgtgtacgtgtgtgcatccgtgtgcgagaaaacagacacacacagacacacacacacacaatgcctgggacaaaaacaatagattagcacataattaatacaaagtgatagttcaatatgataacaagaaccagagattaaattcaatgctgttctcccctaagaatgacaccgaggatgtagtataaataataagcactttagttgaagtcctgtcaaatcgtgaattgaaaaaaggagaccataccaatcaactctaaaacataggaagacacactactcaaagtcgctctgatgaacagagtatagttcatcaagcctatatccctgcattctggaaactaagaaagaagattgcagggggcagaggcaggcagatttctgagtttgaggccagcctggtctgcagagtgagttccaggacagccggggctacacagagaaaccctctctttaaaaaaccgggaaaaaaaaagattgctgggagtttagggcaggcctaggctaccagtgatttctaggctagcctgtactgcagagtaagactttgtctcagaaacaccctccaataaaagaaatcactgcaacatattaattacataaaatattcaagtttcaataaagacggaaagatatacaaggaagtgggagggtaggatctgtataaggaacagaaactttagtgatagaaaatgacttaaaaaacacagttcacacctgacacctgggactgctaatgacaacaggagctagaaagtgctcaaaccatttagggtatgaaccttgaaagaaatagctctgagttctatccttggccagaaactgggacatgcccttgctcctgtcttgtcaggagaccagaaatgcaaaaacaaccactatcataagagaaagagaaaataatttatgaatatcaacagttaaagaagagcccccagagcaccccacattaagtctggcaatggtgatactaacgtttgctaaatgaagacaaaaggaagtaatttcttgggaaacagaagttgtcatcgttgggttataagacaaagataaggagaagcacattgatctactgtagaaaccaaatccaggacaataaaggcctccatgatgtgtgacacatcatcaggcttcgtctccagtcaacaccagctcaggcaggcctcccgctcttgtttgtaggagaaagaggaggctaagtcgggaggagcacggcaagtttggggctcactcaacacggtgcatgccacatagcctacagggtaaaactgtgtctttaaaacagaaacaagcaagcaaagaaacaacaaaatcctcagctttcctaaaacaactgaaaagcaaaagccacttcccaactatcggtccagattaccctgataatcaaaaccaaagagaaagcaaacaagtaaacgaaaatcaaaaatacaaatcagtattgcttgggtacaaagactataacaaaatattacatttaattaaataccacctgaaaggaattcgagtttgggagatatgtcagtgtgaaatgttttctgtgtacatatgagggcttagttaggatcccagccaccgtttttttttttcttttttctttttgtaggcagtatgacagcatctgtcaattcagcgctgggaggtagagatggcaagatcatagggcttataggaagagaacatactacaggcaaatgtagtttattgccagaccccaggggaggttaaacgttttaaaagtcaatccataatgagctaggcacggtggaccatacctgaaatcctagcccctgggaagcagggcagaaggattgggacttcaagggtaagctagactacaagcaagactttatcttaaatttgaattagttaagtaactaattcattaactaattaatgattttaacaacctgggctgagagcataggtcagtgggagagtgcttgcatagcacattccagttttaaccccaccatcgctgaagtgactgtggtaacgccatcttgtcctgattttaccctgactccactttgttcaggtacctttttcagcccctaatcccctaaaaagtccaacccaccttgacagcatatttggaactttctaaggccctgaccacagcacaggtgaataatcaacctaacagctgaatgtataatcaagagaaacgttaccaggtttccccggacccatgcctgccaatgacatcattgcagtttttgcctttacaaatgcagtacctttgagcttcagtgctcttcagagcaggagtctgcactctgttccaagctaataaaggactctaatttggtcttacattcatagtactttgaaactttcttgcttgggctataactgcaaaataaattttccataccaacagttgaaagaagaaacacaatcataccaacagatacatttttaaaaatccaatatttatttattatctatgtgtatgcattattttgtgtgtatatgtgttcataagtatgtacatgtgtgtgtgtgtgtgtgtgtgtggagttcagagagtgatgttgtgtcatttccaatcactctcaatgttagtttttgggacaaggtctcaaagaacttagagtccattatttggctaggctggctggccagcgagctacagtaatccacttgtgcctgataccctcactcaactggagtcacaattgcctgtcaccatgcccagtgttgatgtactcaagtgttcctgatcctgctccaagcacattacaacagagccatttccccagcgccctcccaatcaatgttcttccatgataaaaactgtcagtggacaaggctagagagatggttcagtgatcagtatcgattcctggtcttgcagaggactgggtttcagctcccagcagtcatatccagtagctataactgatgctgaaggtcctctgctacacattcatcatcttgctactgaggtactataggcgcgatgctttttctgtggttatataaatgaaactttataaaatttaatttataaaaaaaattcaaaattcaatttctagtggtttgttgctaatatattagctcactaattttgacttgagaaagaatcttatctaacccagactggcaccaaactcacaagttagctgaatctagtcttgaactccttcatgatcctcctgcttctatctctgaagtattattaactccaattacaggggctctgataccctctgctctctataggctcctccatgcatgtaatgtatataaactcatgcaaacacacggaaatgtaactaaatacatcttttttaaaaattctcagctaggggctgagaaatggctcagtggttaagggcactggttgctcttccagaggatccaggttcaattcccagaaaccacatggtcgtttacaactgtctgtaactccagttccatgggatctgacaccctcacacagacatccatgcaggcaaaacaccaatgtatataaaataaaaataaattatatatatatatatattctcagctaataggaatagaaagaaatgctaccacaacaaagcatatgcacatacaaatcatagaaatgcttaaagtctgaaacttttctcttaagattatagtaaaacaagcccggcagtggtggcgcaagcctttaacccagcactcgggaggcagaggcaggcggatttctgagttcaaggccagcctggttgacagagtgagttccaggacagccagggatacacagagaaaccctgtcttgaattttaaaaaatcaaatcaagattataataaaacaaagaagacctttactgccagtctaaagcagtggtggttgctgttcatgtagtaatgttttaaagattgggggggggggggaaggggagacaggaaaaatattcagaagaatgatcaaaactgaagccacaaacactaagtagactatcccaaggaaacttaggtgccatggctaatctctacaaggactccctgcctcaaaagaaaataaaaactgtaagggcttagaatgtagctcagtgggagagtactgcctaccatgttccattgtgagttccatccctaatactggggagggggtgtttagaaaaaaagaaaaccaaaagaatatacaaaaggataacatatcaacagtagattgtttcaccaaactggtactatccaaggccagtaataaaaatcagtgtggaaaccgggcagtgtggaaaccaggcgcacgcctgcaatcccagcacttgggaggcagaggcaggtggatttctgagttcgaggccagcctggtctacagagtgagttccaggacaaccagggttacacagaaaaaccttgtctcaaaaaaaccaaaaccaaaaccaaaaaccaaccaaccaaacaaacaaacaaacaaaatcactgtgaaagctgtgtggagcacatctgtaatcctagcacttgggaaatgaagactggagggaggatcaggagttcaaggaaaggctcagctacctggggagtttggggccagcctgagttacagaagatcctatctcaaaataagacaaaaatcaatgtgctaatatgctaaaaataaaccagtataaactggaaatttgtaaagtcttgcttatataacagtaggggggaaagtcactattaaagttctacaacagcaaagtgataaatgtataacaaactactatatgcggaaaactaaaacaaagcaaagcaaagctaaaggggccttaatggaatgtgatgcccccagactgacctacagatgaaaagcaatccaaaactcctagcaaaaaatttatggacactaacttactgtgtcaaaaatttatagatgatttctgctttacagtacagaatgctcagagcttgaaaactcattctagcctggcatgctggtacatacctttagccccagcactcgggaggcagaggcagaggcacaggcaggcagaaacactgtgagtctgaggccagcctggtctacatagtaagttccagaacagccaaggctatgtagtgagaccttgtctcaaagaaataaacaaataatgataaagcaagcaaacaaagagcctgggcacagggagagcgatgccatggagagtccaaaaattcttcataatctctcacgatgaacatcggagaaaaatcccatatgcttaggagggtgcaaccaccttcaaatatattcagccatttcaaaatacataagagtgttctgtactgaacaaggctcctgcttaaaaaaataaactgctttgtcaaggactaaaggagatgggaaaggggacagacatatctgggtacccaattccagcctgaagtttccaacccacagctctctcgtcatcacatctcacttacatggagggggagagataattaggagggtgggcaattgtacttcacaacccaggagcacacaagcagtaaaagacagaataaccagggacattcagaacatgtcaaatcaccacgtatcttactaccacagccctacaggcctatgtactgtagttccttttactggctacatcatacttgactttcaaaaaaacctgagaaatgagggggggagacagacagagagagagagagagagagagagagagagagagagagagaatacaaagcacatgccctttaactgtcaaattgacacagtctacagtcatctgagagactgatcaaatcacactggcctgatgggtgccatcattccctgggtgagtggttccgggatgtataagcaagctagtacgcacaggtgagccagcaagccgtattcctccatggtttcttcttcaagtccctgcttgagtttctgctctgacttccttcagtggtggattaatgatctggaagtacaagccaaataaatcctttcttcctctactttgcctttggtcagtgtgttatatgacaatagaaagaaaagtaaaacaaaacaataaagacaacacagtttaaaattaaaaaatccagcatgtattagtatcagacttaaatacgtactgaatgttggaattattaaactgaaatatttgcctgtttttcagtgtcagttcaatggctgaaagtcaattaatagccataagtttgatggatcaagtctgaagcagaaagattgggaattccaggccagcctaatccacatagcaagaccctgtctcaaaaacacaagaaagaaattgatatgaacacagtctcagagcccttggtgttacccgaagggtggagcagcaggatatttttctcctgagccttacaaaggtcatattgggggagtcacatgtccagtcacatactggagcctaacctgctgggtttcttgccttcaaatctccatagaacttaagtgatggtattgttacatctcagaaaggtcagattcatcactgatgtcctgataaccctctcgttgggaccacacatatggtcttttctcataattggctgactgactttcagtagctgaatcaaagtcctgaaccactgctgtgcagaaagatccatcggcacagtaacgttttttacacaagtggaaataacattctaaatttgagtctcgggcgctatattgtttactcttcaaaagtaccatcagtgtcccaaagaatatagcattcccaagattcaaatatgtgacttcctttgcctgcatgcagaaccatttaaagtgacttatagtgtagccgcccgcgtaatgccctgttcaaagcttcctttgtttatgcagtggcaacagttgccctgtatctataattaataaagattaattgctaatatggactattctggtcttagtaagatcctatgcaaatagaaattattacttttagttttgtttttatttattaaaattttaaatgagatttatttcattttgtgtttgtgcatcacgtgtctggtacccaaggaggtcagaagaggatttggaccacctgggacttgagttacaaaatattgagaactcccatgcaagataccagccatgttagatcctcatgtcacaaaaaaattaagtggagaagctgagcttataatcctagctatttgggaggcagaggcagaaaaatcaagaccagcctgggttattacacataaagtaagagagacaagctgggcatggtggtacaagcttgtaatcccaaagcttggcagctagaaatgggtagtgagggtcgtggacagcctcaactacagaagacttcattaaggggctcaaaaagtgggcttacgaccgcctgtaactcgagttccacaggattctatggcttcttctggcttccataactgtactcatgtgcacattcctacacacacaattagaagcaaatcttaaagtgggaacagatctagatatagttcagtggtagtgtgactgtctagcaccacagtgtcctaggttccacaaccaatactggggggaaagggggaaataagcacaattactaaactaaaaatgatgcttaatctacgggatgacaaaagagtgagccgcaactgtggagaaatatggcaaaacgtcaactctaatattagggtttcattttattctctgtgtttgcatttgtgttaaataggtcataatatataaagctgccgaaatgttttaaaaatagcaaacattcctttgtcaccctcatacatatatgaaaaaaatgagatcatattatcctacaacttgtttttaatgtaacaagctatcatatcatcttttacaccaaagagccaaaatatacagacttttaaaacatcctcctattaatggatacacaggttgtttcttatcacttgccacaagaaaagagctgcatagacatcctcttttaggtatccttatttatatactgatgcttctctttctgaaggattgagccgtgaaagtcagactactgagttccagatattggaacttggtactccatatatatttttatttttctaaatatagctacatcaatgcttccaaatggttgcaacaattcatactttattcagcaatgcctagctaaggtactgaaatgtctttttgaccaagtaagcatctaacaaaagaacacagatcaccctataaggccctattataacagatgctcccagaccacaaatttagtaacatactctggtcctcatttggagtacataaaaagggcatagggcaaaaagcgttattataccataattaatgttaccaataagctagttttatcaactactaagtgttgatgagaaagaactgaggccgtttttcgaggcctctggggagctagaataaacactccattttggagacactcactatccgtcaaaccccaattagacaaaggaaaacaaaaggaaacctcaaaacacgatctctcctaggaatgagcctccccagcctgacaggttcatccgtggaggtccggtgatgtgggcactgatcactcatctattgtgggcggaataggggagaaatccggagtgccagccgccgactactcgtcccgctcggcagaccatgcggtcggagtggtgaccgctgcggcgggtcggcgtggtgaccgctacggcggccatctctctgacagcgcgagacccggcactcaccagggcatgttcattaattggccagtttctccactctccttattaagtcatcctctagctgcctggctaatcccgggaaggacgtatacatgtggacgccgccattttataagttacagaagcctggtggtgccgtgggggggggggggggggggtcgggcgggcggagagcatgcgtcacagccgaacagtccctgtgccgcgcggcgccgcgctgtcaggctgtccctaaatggctgctccagcaacgtgaccgggactgtccgcggtcgcttccgcagatgactgagcgcttgcggttcctctcccggctgcctctgttagcatctttcacgtgctcccgcgtttcttgcccgtctttaatttgttctcttgccaccccctcaccccccaccccccaccctacccccaccgaaattcctttttcttttttgtttctatagaagaccagcttgtgttttgctcccgagatctctttcggagccccttctgtgtttttagctgccagcattgctgtagctgctataactgcaatctacatgtcacagaggctaggtggcaaagtaaaccacaggcctgggtatgtcccctagtttttgataaagacagaattataccttgtcctattcctattggacacctcacagggccgaagctgacaataactcctttggcttttggatgttcacaccaatactggttaccacacaaattagaaaaggatcttgggttatcaataaaggcagagaactacacttccatttaaaaaagaaagaaaaaagttctcattttacctattgcaccacgaggcacaggggcagaagcgagtgctcagtggttaacagtgcttaatgctctagcaaaggatgcaggttcagtccccggcacatacttctctctacacagatctctctacacaggcaaacatgtatacacacacacacacacacacacacacacacacacacacacgaagtaaatgcatgtgtgtgtgtgtatttaagtaaaaccatgttggaaagttgccgaaggggcctcagtgaatatctgcttgaggaaggctttgctaaggcaacctgggacagctgtcatggagccgagggctgtcctctctccagaaggtagcacattttcccttacactggtttccctctttcccaagacagcaaagccctggcttcttttcattccattacaggcagttctttcctgtgcgagctctcctcagctgtagccagaatttgcctgtttggaatcctttcttcctcctagagtttctctgagatggcaagtttgtgaaaattattacacacacacacacacacacacacacacacccatggccaagacaatcaatttgatatgctcctgtgactataaccactttattgcccccccccatttaaatttttaatctagattcccttccccctctctccatgtgctcatggccagcctctagttctctactctctctttctctctctctgcctttccctgcctctgctaccctcttaactcccctccccatgccctgaataaactctattctatactaaaaaataaaattaatctaaatataattacatattctcccccattcccttctccaattcctcctatgttattcctcgccactacacacacacacacacacacacacacacacacacattgcctctcaaatttctggctttttgtatatatgtgatttttctctgggtgcgtatttggtttctacttatctttgttgttgaacaccccaaaagcagggctggagagttggcttggtgtgtaagagtacttaatattctcacaaaggactggggttcaatgcctagcagctgcatgaggcttctcacctcctctgacaccatgctcgagtgtggtacacagacctatatgcaggcaaaacactcacacacataaaaattctaaaaaaaaaaaagtttttataaacttaaaaaaaacaaaagtcaaatataaaagttgattcagggtatctgggagcccaactgtctgcatttccaacttcattctaatgtctgtggcaaaactgttgaaagaagtacctaggaaagtgtgactctagctaatttttaaagatttggcttttcaggcatgcatatcgttgttgctcttctgtttttgagacagggcccccgttattccaggctggcctcgacttattacgtagcagagaatgactgtaaattcccaattctccttccttccccgggcctcactttatcttctacaaacttcttgtgacatactcaggcctttggcaatagactaaaactttctggttttttccctcatcacccctttttgtccatatgggaacaatcttttagttttaggataaaaaccttatactctattctcatctaaaagtatttccttaatttcctttaattttctttatataaatgacctataacttcttacaatattttacatttatttatttttgtgtttgagaaagaccaaggcggggtagaagaagggagagagagagagagagagagagagagagagagagagagagagagagagagagagaatatatggatgtgtccaccacatagtttccaaggatggagctcagggtgtctgccaggctttgaggtaagctccttatcagctgagccatcttgcagtcaagactcagcccgtgtgtgtgtgtgtgtgtgtgtgtgtgtgtgtgtgtgtgtgtgtgttactaaggactgaatccatgattttctaattacatgctaagccattgctctaccactgagccatattgccagccccaagaaaaatgtttttctttctttctttattggtatctcaagatagagtttctctgtgtagccctggctgtcctgaagcttgctctgtagaccagactgggaatcagaaatcctcctgactctgcctactgaatggtgggattaaataaaactattctttaatattctaaatgaaaatcaaagaaaagctgagcaaagtggtgcttgcctaaaattccagaatttgagagagttaggaaggagcatcaggagttcagctcatcttcagcaacacagtaagttccagatcagcctgaattacatgagaccacgtgaaagaggggtggagagcaaagccaaagcaaaccatgaggctgtatatgaaacataggaaacaacatgctatcagtctttgaaacagtcctgtgttttcttacaatttaagttgcactgttgttagaaatttatgtcctgttagaacaggttttcagaaagtgcttttgctaaaggtattgatggcctacttggcttcacaaggtaaccaaccacaggattaaagacttgagtctctgccttcattttgagtctgtctttccgttcatttcaaactcctgcttgactgtgcataggcatattaataacagaaggagtgtcttcctaaattatttcattcatccttagtcatgttgaactccaagagcaaaacctcccaggacagaccttcttccatatgagggcagttatccatgatgcaaggcaaaagtaatcagcttatgcttcaaacatgagccaccctttaaaaaaacaagaactctctcaagacatagtatggtctcaagctcaaagcaattcttctgctgggattataggcatgtgctaccatggccagtcaagatgagggtttctctgggctatcttgcagtaccacaagacacaataattagtcaggctacacctcgaagaaaattacttttttttcataatgagctacaatttatttatttattgaatttggagtattcctcgatatcatccttggcctaagattctttgccatagtccttaaccactacgcaacagcaaccgaccaccttccgtggtttcccctctcgatcgattctacagaggcctacccattcccctagtttcttgttgtcatcaacctttatcaggttgatttggtgctcagcacaaagtgcctccaccagcttgacatacatgggctcatcacagttggatgcgagcacacagagatgggcttggcgcttgtctaactaaggctttggcagcttcgagtatgccacgtgctaggccatcctggatgagggcggtcttgagcacctcttgtagagcagtgttgacgtccattacacctccagcagctatgccttcctcggccatggcggtggattatgggtgacgccgaatcttgaacgcacctgagcttctgcctccgcgcaaattggtggcggcaggggaaaaaagcgaaaattacttattatgggtactccttgttctctattgaaatgtctctcctatttttagtttaaatctcaatactccagcgataggggcagggtcgttgaacccttctatggctcttaccacttgaccacctttgtcatcaggttatgctactctaagttactccatgttatataaaacattattagctcgtgaggtcaaactgccagtggcctattctttaaagaaaactgaacctggatcgtctggaaaagcagcgaatcctcttaactgttgagccatctctccagccccccaaatgtattattatctactctttctgtttgtttgtgtttgttttcaaggcagggtttctctgtggccttggctatactggaactgcctcggtagactatgctggtctcaaactcagagatccatctgcctctaactcccaagtgctgggattaaaggtgtgcacctccactgctcacattccatgggtttatcttaatcacatctcttttattcatattgcaacctcaccagtaccctcagtaacgtcatttaaataaaacaaacaaacaaacctgggactagagacatacctcgatgcttacaaacatttgctactctttcagaaaatccaagtttgattctcagcactatcaggcagttgacaaccacctataacttccgctccaggggctttgctgctctcttctggtctttgagggcacacacagaccatatacataactaaagtcagaaataaaccttaaaaactcaatacttttcaatgatgtaatggggatctaaagagatggctcagaggttaagtatttgccataaaagcatgaggaccagagttcaagtccccaaggcgtgaacccatgtgaagccctcctataattgcagctatgaaaggctcaaacagggatccccagagcaagttgcctaacaagacgtgccatatcagtgagctctcggtttggctaagatcttgcctcagtaaacaaggtagaaaaatgattgaagacattaaacttaggcctatatattcacacacatatacatatgaacctatatacatgtgtatccacatctatggacaaaatgcatatacacacaaaaatggaaaaggcaagggtagagtgggaagatgaacaaatgttttctttgctctctcaaccttggttataaaatacttcctttaaataacagaaacttaaaaaaaaacaaatcaggtatatagctactactgctggacttcagtccatgcccctcccaatacccactcatatctttccttcatcttattcaataagcattcttaagttttctgtaatataaatcaagaatcacaacaatatataactagagagaactctgcggttctgaggattcctcaggttgcataattgtgaccatcaacttgcattgcctgctcctgtgccaagactataacaccggagtatgtaatccggagtatgagctgagaggggaaaaactgatgtggcaagtggaagaacagatatagaatctatgtatttatttacttatttatatataataaaacacttatacttatcacttatatctgtgaccggtagcacatgcttgtaagcacaacactttgtaggcaggaagttcaccataagttcaaggctagtttggtctacatagtgaattccaggtcagcttaaacagtccttggaataaaagaagccacagagatggcttagcagctaagaacacttgctgctacagcagaggcccacattaagttcacactcctctgagacccatccaccatggctctgcttcccaagtgctcgtattaatggaatggatcattacatcttctccaaaacattattatttgtatttacatttgattattacatgccaggagggttttgttttttgttttgtttggtttttttttttttttttttttttttttttttttttttggttataattggtactctataagcttcttgtatgtttataggcttctctttctttattcttttcttttttatgaatgaggcaatttattaacccagtattattttttctaatgcttcttgttggcagctgccacctgttcagcgatcctgtccagatgtgtttcctgtccctgaggtgttagcttgcggcccccatctcggcccttttccaccattttcagccctttcagggcttggaggacctggcaagccatactctcagagcctctgctgaagtggctgggcctaacaccgttcctctgccatccttcatagatcttggtcacggaaccaactcctgcactacagttgtgtacagaggtacaggtccggagttgtggaagcagctcgtgggtagaaccagttctcatcatatggggcaagctctttatgtttggctaacttgactgtgtccacccattcccgaactttcagcttcctggactttttgaggaaggctgccagcgctctgacgaacctgatggttaacatcttttacagtgacttcaggcatcgttcagcctccatgctgccagccaggggaaagggtggcatctctttaggttgggaaaattttcttctgattttgttgatatttttccgggacttggagctggggactcttcactttctattactataacttataagttggtatgcctgttttatgaggtgctggagattgttttttgttatcttatataaagtctgtgaagttgcacatgaaagcctgatctttagatcccttagcactgaaattacaggcagtaaagatttgtctagtgtgagtgtaaatcttgaactttggtcatctggaatattaagcatctcaagagtaatctaagagcagtcttaagcaccataattgatcacttcttaggtctggggactaaagacatgcaccacgtccacctggttgaccacactttaagagatagcattgtaaaggggctttctaatattttctagggttaaagtctattgtcttcatggtagggagcatgtcagcattcaagaagacatagtactggagtttgacatctggttccacaggtagtaggaagaaagccaaccaccggccctggcttgggcttctgaaacctcaaagcccactccctagtgacttatgtccttcctaattcttctaaagtagtgccacctcctccccgctcctgatggcttagtgataaaatgtctgaggctgtaggagtcattgttcttacatgatctttggtagattgatttctgtatagggtgagatagtaccactatgctaaggatcacttggccaagtgactgtatgtctcttacatgtggtgtttgtacctttgttgagtagtggatggctgtctccaggtcctctattctatcccactaatttacaagcctacctatgagcagtagcatgttgacgctgtggtgcaacctgttcattcatttgaagctttgtcatgtagctcaatctggtctccaattctctatgtggctatttctgatcatccttgtaactcccaagggctgggattcacaggcataagctacttaccatgtcacctatttttaaaaactatttatgtgaatgtcattagaattttgctgagtatagcgctaaatccatagatgggtttttgatgcaacttagacaatattatgttgattcatgaacttgggagtgtttcttcaaccattttataccagatcaacccctctcccaatatacgttagaattgaaaaaaatatagatttcctggagagactggatgcctgatctacctatagttgtggctccaactttctctctgttcacagagccagtagtgtcattgaacatcccttcctttaaaaaaacaaaccatttttcatgatttattttgatcatttttccttcctccaactcttccccactcatccaaatccatattcattttcttaaaaacaaaacgaaaactgcgctgttttgtctggatggtgttttcttggagtcatttactgcagtctttctgactccttatcttcatagatgcctgagcattgaaagaaagggcttgatgaagacatctcatctaggaccaagtgttctaaagtctcttactctctgcacattggaagaccatttcttaactcccatttctgtttcttgctgctttgtagtgggtccttgtttcttgacccattatcatcatcatcttgttcttccttcttctcctctttgaatttgcatggagaattcctcaagattactattttaccccaggtgcatttttaatcttaatgttaagaatatgcaatgaggcaggcagtggtggcacacacctttaatcccagcacttgggaggtggaggcaggtggatttctaacttcgaggccagcctggtctacagagtgagttccaggacatctggggctatacagagaaaacctgccttgaaaaacaaaacaaacaaacaaacaaagaatatgcaataaattacctagttaagtgtacaggaatggaggtgttttttagaaaaatatttatttaatgtgagtacactgtcggtcactgttcagatacatcagaagaggttagatatcggatcccactacagatgactgtgagccactacgaagttgttgagaattgaactcaggccctctggaagagcagtcagcactcctaaccactgagctatctctccagcccaggaactgagttttagcacatatcccttcatgctttcttgtgataagactaaaaagtgtccccgaaacctgacataccttgatgtacacggtgtgagaaagaatgatgaggtttgcaagaattgggactaagtaaaacacagagactaaatttaactctttaatttgatgattctctctagcatccccacaaaaatgatacactggcttgcataatctgtgaccagtacctcgcaagttctaaattctctttgtacagctcatttagaagttctcgtttatacaaagccatatccatcgtggagccaggtgctcttagctgtgaagagcccttccttgggtcttttttccctaatatgtcctatgtgacttctcactggtgatgcttttggtgtgcttgttactctgatcctgatcgctctgtcaactaaagttagacaaagtaacctttacttctcaattcagataggaatccttttgcactccaagtttggcttcagatgccttggaaagattcatgctgccacctgctggtttattcagtctgtgtgcatcatttatttacttgttaatttgtttttcttttgttgaaacagtttattttgtagcagatatttttccatccctacctgaaccacctcaatagtaagattagtgaattgctggcactttgatcgtccataagcaaaccaattttgtgtcctttattattcatgggacgcctaaagggaacttagaacagactgtgaattatttgtcagcgtgaatcaacgagacaacaatatcctttgattttctaatacccagggtgtctgatctctttcatgtggatattcatagtttgacagttaacaaaatttgacagttcttttaagttagcagtgtctctggggcgagtaagataccaatgagctattattccctcaggctttgctttggcatttaggaattatttttcattactgctagcgagtaacgtacttcagtgcgtttttgtcccaaggtatggagtcaccaggttcccagagaaagactaagatgccaatgacccaaaactatgagcgtaagcccaccaaatcggtcacaactaatactctgataatttaggaaccaaggagccattttgtgaggcatttctaccctttcctctcctcatctgaggtcgccaactaatgcagaagaacttctagtgtccaagacgcggagcgatacatggtttgtccaagtagaagatatattgaaattttgcatagacaggtgtgtgacctaatgtacattatttaatgtttatgtggaagttctacataaacgtttttagctgtaaaataggataatccttcattatcgcgcaaaataatgaaattcacgcgtcatgtcactgagcttacgtacctccatctttattcattttaatttttttataatatagttagacctaaaggtccaataagatgtcagaattgcaatctttgtggccactcctcttctggtctctccgccttcagcgccgcggatcagttaaaggcgtgcaacggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtgtagcaatggattataggacatttaggtcgtacaggaaaagatggcggctcaagttcttggtgcggtataacgcaaagggctttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacggatttgcttacttgttgaattcattttaattacctttagtgaattgttactttggagtccttaaagttttcaataatttttttggcagatgatactcaaattacttggcacttaaatgtactttctttcaaactcatccaccgagctactcttcaaatttttaagtcttataacacagatactgttaatgtaaagtgaacattatgactggatgtcaggagtatttgaggttctataccagttcaggctttgcttttgttgctattgttgatgctatattgactaatggttttacttgtcagcaagagccttgaattgtaatgctctgtgtcctctatcagacttactgttataatagtaatattaaggcctacatttcaactttctgtgtgttcttgcctttatggcatctagattctcctcaagactcagcaaatagtgctgctgctattgctgccccagccccaggcccagccccagcccctgccccagccccagccccagcccctgccccagccccagcccctgcccctgccccagcccctgccccagccccagccccagcccctacccctgcccctgcccctgccccacccaaccaacccaatccagtccagccctgccccagcccagtcctagccccaggcccagatactttcagacctatcccaagcccacttctacttagagaaattcgaatcttcattgattcagtgctaaaatgcagtgtccatcactcagcctataagactgagacagcccatctataccccctccatactgacttctagagtcatggaatttcacttaatgcatagaatcgtattgctaaaatgcagtgcccatcactcagcctataagactgagatagcccatctataccccctccatactgacttacagagtcatggagtttcacttaatgcatgcagtcctattgctaaaatgcagtgcccataactcagcctataagactgagatagcccatttataccccataccccctccatactgacttctagggtcatggaatttcacttaatacatagaatcgtattgctaaaatgcagtgtccatcactcagtctataagactgagatatccctatgtataccccatactccctccatactgacttccagagtcatagaatttcactttgcatacggtcctattgctaaaatgcagtgtccatcactcagtctataagactgagatatccctatgtataccccatactccctccatactgacttccagagtcatagaatttcactttgcatacggtcctattgctaaaatgcagtgcccatcactcagcctataagactgagatagcccatctataccccctccatactgacttccagagtcatggaatttcacttaatgcatgcagtcctattgctaaaatgcagtgcccatcactcagcctataagactgagatagcccatctataccccataccccctccatactgacttccagagtcatggaatttcacttaatgcatgcagtcctattgctaaaatgcagtgcccatcactcagcctataagactgagatagcccatctatacccactccatactgacttccagagtcatggaatttcacttaatgcatgcagtcctattgctaaaatgcagtgcccatcactcagcctataagactgagatagcccatctatacccactccatactgacttccagagtcatggagtttcacttaatgcatgcagtcctattgctaaaatgcagtgcccataactcagcctataagactgagatagcccatttataccccataccccctccatactgacttctagggtcatggaatttcacttaatgcatagaatcgtattgctaaaatgcagtgtccattactcagcctataagactgagatatccctatgtataccccataccccctccatactgacttccagagacatagaatttcactttgcatacggtcctattgctaaaatgcagtgcccatcactcagcctataagactgagatatccctatctataccctctaccccctccatactgacttccagagtcatggaatttcacataatgtatagatttctattgctaaaatgcagtgcccataactcagcctataagactgagatagcccatctataccccctccatactgagttccagagtcatggaatttcacttaatgcatagaatcgtattgctaaaatgcagtgcccatcactcagcctataagactgagcccatctataccccataccccctccatactgacttccagagtcatggaatttcactttgcatacagtcctactttacttgtccatggacaagtaaacaaagaactcttgtccttcatgttaatcaagatacaccaatcaaacaagagttttatatcagagacttgccatggaggtatcatctctcaagtctcctttcctttaaggaaagaaaaccattctgtcattgctgtagtagtcacagtcccaagtttctaagcagtgttcagtcgtcttttctcatgtattaccttgagtactgaataattctgtcagaaatattttgtccattggattagactttagctagtccagccctgtgtgcatttagcaaaggggcaaacacaggtctgttatcagacagttaaagtgctcagtcccaattttcaaggcattggccattaaagggggtagaatactatatactgttggcatgctgtcatgggtgctatcgccccaggtcacatctttctaactgatggagatacatttatttgctcatgatattgtatactagtctcacatgctttcttatttcagccaaaaacctctgcactggaacattttatgtggataatcctgactaggaattgagtcttttctcaaggtcctaatactacccttgctttatgtaaagagggtgctgattacttaatgcctcttacacaattgtgcaaaattgcagttgttcaagtccccttctgttagtaaccaagatcccataccctcataccctaatgggtgacaatcaagggtgccaaccaatgagaccacttctctgttctggtctttctgctgtgctggggaatcaaaccttgagtcttgtgtacgctagtaaagcactgtcatagagctacagccccaccgtgtggtggtttgagagaacagcctcttatgtagcctgggctgggcgggacttacaggcattgccacctgtaatgtaaacatatttgtgcctgttgtgtgcacagctgcatttgtccctcttcctaagcattggataaagaaaccaaactaagtcaagtcattttgttggtaatcaagaagacctttgatctgtcctgtttttaacttccaggctggcctggaacttagcatataacccaggctagccttgagctcaggatctagcctgcgtttaacaagtgttggcatatctggttcctaccactatgccctgcatgcagtctttcatattgtgaatgtgcatatgtcatttcactgtagtaatctgcatctggtgaagacttatttgtattgcagcagtatttaagatccttaacatagtaaatgtgcacagtgttaactctattgtacatattctcatgtccacagttgtgccttttagatcaggactcctgtacttagcaaagcaaagaggctcactaatataaagcttctttcatgagactatagattgaaacgattccaatacggtcaatggtccttcaaggtaagacttctgtctctgatcattcatatcctctttgctttatggaattatgtatgtgctgtgcacttgaaaccccttcctcaaactatttatgtacatactggcaattttagtaggatcaattttactcttaactttgaagtacagaagtggtgttgacctataaggtcccattttgtggcttgctaataataatgactgattgtagtaggccttttctgttcactacagaaggaaacctgaacagcgtaaaactgtaatggccataaacatgtaccttgcatattagtatgcatttactgcacacatctcattccatttggatacgatcctactctcaaacccttttgcagtacagcaagggtcactaatcttttggcttcttcatcttcctggacactggataaggctgtcccctcctttccactctttaatttccaggactattactttaaagacttaatatttgcataaaggatggggtttttaattgataacatgtcccttgaacattaatgtatataacagggacatgatccattcattttaataaaaatacttggccagttaatgtgtaaaattacacttatccacaaccttattacttttcggaccattgtatctcttgcactcctgcaagggataccgtttatctcccaaggtccctgctagtggaccattaatatacagtgaatcttcctttgtctttgccagtaaacaaaggccatactccttcgcctttcatttgcactatatcaggatatgctgatcaacaaggccgcattcttttggactgttatcatatattaaatgtatgcgtatgcactgccacctgctctgtgcacttgaaaggatcccactcacttccttagcaccttcagcaggaagtgataataagctcaagactttcatttggaaagttcacatgtctaagcacttctctaagaactactgtaccctcttctccgctttaaagcagaaagagggttgtacgaagtgctcttcatttggacttaagtgcattaatgcagttagttgtccatcattacctttggagttggattttacatccttgtactcttttgacaccagaggcatattaattatttctgagcacttctcttgtcaatattaatctgtacccttacacatatgacctgtgcggcagcaaaggttctgaaatgcctaccttttgactggggctgctgagtggtagtaactattagtaacctcagcatttggatgattactatgcaaaaatgtcaaggacctgtgtgctctctttgcataccatcaaggctactgagtcccagaattaattgctaagttatgcgtatttataactatgaatgtctggaatattttgtcccctttacattattgcagaggttgctgagcccccgaaactacccggtactgtcaatgagcacaggggctctgacgaatgacctgctctcttccttaaactgattttgggactcttaataggcacaatggcagttctggatggtttattttctactccaacttgagcaaatcccctgctagtttcccaatgatataataaagtacagcagtatgtacacccaacaatgacccggatttcgaccctttttgcattgctttaatatatacaatcctaaatagtcacaatctcacactttatagtgttccttttgcccggcctctagtttgtccattgaccacttttctgaatcactaattctcacaaacccatcattaaggaagagtttgtgccctttctcaattccatcatgccatcccttttgcctctttgtttgaacagtattgactgggcaaagcccttctcttgacttaaagtcaacaacaccagtttactcacttcatatggctacagtgtctcagttgccttctccttgctcccactgaacagagacacctcgaattcttacattattctgggtaatgttaattaccccaaacaccctatgtgtcattaataaattttggtgtatttatacactgaatagcaaaagcaggccaaaactaggtggatgagccttcaatctttaacttgcacttctaaattattccaattccaactgctggcacattctagggccaggaaccattcttgcctacctttattaatgctttattgtgcaaaatattgcaggcaagtagctcagggagttggattgccaccttttacttggggctttcctttacagtatgaactgaaaattgtcttcctgagaaggaagcttagcacttttctttccattcttcctccaggaaggagccaactgtctgcttaagaaactttaagcccgattttgtatattgctactgtacaggaccaactgccagaaaagttattgataattttattccttaagaaaggcatttggattgcaaggtggattgactgtgagatcattagcttttgtgaagtaaaaatagccatttgtgtcatgtttctgaagactaagcagtgtctcagtgtactgagggtgatgagtctgtggaaagatcagtgcaactattgcagaatgtttaagacaagtatctttgcttggtctttactacaagtttaacaaaacgaaaaagtcaatctttgtgtggcctttagtatgattaactttttggaagatgacctaagccttctaatcattatattttgtctgacattggtcaccagtccttgcttatttttaaaaggtgactggatggattaaatttgagaacatgtcaagtcgcctttgaaaattatataggccatcacatttaattaattcattctatccaccattaaactctggcaataatttgaagtagcttgaaaattcctaaagtgggaatttattttagagatgatagaacctgtttccccactttacattttaaaatatgtctgccaggatctaatcattcctttaaacgtacacttcaaagagagattttcctagtaagaaaagagctttctctagtgtgaagggtgctttgtagccgccgagtacttaggtcttttttgggagctattgtgtatgagtgtatgtatgtgtgtgtgtacatgcatgttgctgcgcgcagtcattcattcacatggtgctcagacaacaatgggagctggttcgtctatcttgtgggtcctggagatcaaagtgagatcatcaggcttggcagcaagtgcctttaccctccgcgtgccatcttgccatcccgctgctgagtgtttgatatgacattgctgatgaaaataatcatcacaacagcagttctcccagcattactgagaaatgatactatttttctgaggaggatgttcaagtaactcatccagtgcaggatcctgcttgaactactgctcctccgttacatcagactctggctgtttagactacagtaagtactaccttgttagctactaagctatctttttctcattcgagtttctttctgtgccacccactgaaaagtcaaagtgactaataagtcactagctcttctcagcttatccatacacaacacatagtatgccaacgaaattgtagaattaacacattgtgtacccaatcgccattatgctggggtacactaaaatgagaagcgatgatattttacaaaatttcttccgtgagatgattatgttatttaagacttaatgtaatataagcacacttgagatcattttaggaaatgtactgcctgtgtgaattgtttaagtattttaggaagtctactggggttgaaatttgacttcttaaagagggaagtgtgcttactttgccttgttggtccagacgactattagtaccatctggttggtttatctgaatgccatctgtttctatctacctcttggaagcatggaaagaatattaagagtgaaagactccatgcattatgcttagctgtacgccaagggtagcaagagatgagcttgtgtaggaattgggaatataaatttgataatttggttctttcaaccatttttactgcatttctgcccagaacagaccactggacggcactaacagcttagacagagaacttcatagcttacaatctttttttttttttttttttttttttttttttttacaaaagtgcaaagaaggataagttttatgaacaaattttactatggactactttatgtaccctccttgctcatttttctttttcattaattaatcaattaattttgttttgttctctgttttgttttgtgacagggattctctgtgtagtctggctatcctggaactcaaactcaagagatccgcccgcagagatccgcccgcctctgcctccagtttagagtgttgggattaagggtgggtgccacactggacccctgccagcacttttcaacagatactttcagttaaaacaacaaatacttgactcctgtgtagaaaatggtctagctgaaaaaacatccttgtccataacacttaacatttttttgcatttgccttttgtacgtgcaaatgaccctctagtactttaacccttttaagtccactgtaaattccttcgcagcaggtttcccccaactccaaaggcttagcattgtctggctctctaggtgataatacatctagaactattgagtcttttaggaaactaggaccattgttgtacaagtaactgcttcaaaaggaaacatttgcaaggaaaaaaagctttttgagatgctaaagaatgtgtttggtgcactaagacagttagctaaagcttcggtctcaccttagcaccattggctacccaccccagtacatgcaaagtgaccccccccccaggcttgcctaggcacctagagctttcagcctgcctcctatggacctaaatagagattaggactcagactccagttagtggcctggaggaagctggtactgctgctattcacagtaaacccactatcactgacagttccctattgaaatgatcaagttgtgtgagcaggcagatcattaatcagggccaattctgtcatggcaacctagtcctacatgacctccacggcactgtaaaatacacacttatttgtagtaggacatctggaacatgagcttgtctgtgattgaaatgtccattaggaggtgccatcacacaaaaccatctggaggccatctttggtccccataattgatggaatacaaagagttccccaaattagtgtcctgacccagccctcactgtcagtaatcatgtaatggaaagccaccaactcgccatcaccatcttcaggctgcctgaactgtatacattaagaatgagctttcagccgggcagtggtagctcgagcctttaatcccagcacttgggaggcagaggcaggcggatctctgagttcgaggccagcctggtctacagagtgagttccaggacagccagggctacacagagaaaccctgtcttgaaaaaaaaagaagaatgagctttcttccaagctgtccaatggcttgacccagacttaggagtttgtaaacaaagaaccctgtagaacaagtgaatttgagaatgtacaccttcattaagtggtgggaagtggaagtagtggattttgccagctgattttacaaagccctgtggcagaaccagaccaggtctttgtatgcatactgccatataacctagccactgtccaacctgtgccctctctcccagtccagtgaacctcttctgcctgccccttacttagtcctctggctcatcccaggggaagatggctctatttgtgtagtcataagaaagttttgttaattttaaataaaacaggaaaagagaaagctcacttaagacgagagctggagagatggttctgttagtcttccagaggtcctgagtacaattcccagcaaccacatggtggctcacaaccatctgtaatgacgtctgactccctcttctggcacacaggcatacatgcagatagagtactcaaatatacaaaaagggaaaagaaatgaaaggcctttgaaatgtagacatgctttcaattttaaaggctgttttcacatctcttaagaactaggggttccatgagaacatatcctcaccctgagttcttaccaccaattgaaaacgctgacatgtgcatatgaagattgtattgctagtaatcaaattatcatttgtagagtttagtataattatcatttgttttccagggatgaatttggagtctgttttgtgctcctgcctcaagaagaaggattgcctggatttagaggagtgaagagtgctggagagagcccaaaggtatttccgttacttggttgactgagatagtatcttcccttaaaggtctaatgtgtcaagttatacctcctaagtaaatacctcattattttcatgtggaattttcaacaatttttgtagtctaatgatagccttgtatttcttcacagggacaaacaatccctatgtgagactcaaggactgccagcagcctatacagctacattacatctcagcagaacttctcttcaagtcctcgctactctgaacaaaaagcttacaggccacatggagaaaaaaaggtactttggagaatttgctatttgggggtttctatctgatctccagttcatcagagaatgagggggcaagtcaataaagcactccccatctcctggtcccctggcatagtcagttagccaatgagatccttgccttatgatgaggccttgaaatcatccccaccatgttatgaccaatctgtaacatttctgctctgaaatgcctaaaaggtaggttatcagaggaatgaaggccagtttctgacaccctagtcttttgtacttgatagagtaagtagatatggctgttgtcacattctgtaggcctgtcataattctggtctctgaatatcctcaaactcagaggtccaatgctacaccagtttctagggacatatgcaccataagcactgagccaaacaatgctattcaccttgccagtgttctggcatggtattgtttaaagcacaaattaaaagaagaaaataatttaacccctttattcccagagtatttgaagtacaaggactttaacacaacctataatctaaaggatctctcattggtaggtgacagaataaaagccagaaagaacttggatggagcaattctcatgtctctaagttaacactaagatctacaaatgtgaagggttcactctccaagcccctccccatgatttaacacaactgctggttactacataatgagacaactttcccagtattcttgatttcaagaattggcttttctttcacctcttttccagatctccccccagaattgtgggcttgctgctttgcagtgctggcgacctattccctttgacgatccctaggtggagatggggcatgaggatcctccaggggaatagctcaccaccactgggcaacaggcctagcccagatttcagtgagacgctttcctgaacccagcaaggaagacaaaggctcaaagaatgccaccctacatcaaagtaggtaagttttctgcaacagtgtaataattttaactttgatcttgttttccattaaagtcagccttttacttgagatatatacataaattttatctttttcccacatctgggaaatgtaactaaacagtgcaaatgtttcttctaggagaaaagctgctgcaatagtggcactgaccttcgaggaagccattctgctctatttggttctctctccagaagctaggaaagctttgccagctgtttacatacttcaagatgcactgctaccctactcatgccatataatacacaagtgagtagcttatttacctacctagctatttacgagtacactgttgctgtcctcagacacaccagaagagagcaccagatctcattacagatggttgtgcgccaccatgtggttgctggggattgaactcaggacctctggaagagcaataggtgctcttaaccactgagccatcactaacattactgatgatgaatgcctctaactacaaatggaaacctggctggaattgatacagaagtatctatcattaggcagaatttaaagagccaggatgttctagtacttctttcctggcattcatacagcttcttttgttctttgtagtgccatctaccaaatattacccttccccaaagcagcacagaaaactgggtcttcagcgtgatcaagcaatgtgaacacacaaaaggaaggcagctttataaatgacccgaggatcaacatgcctgactgcagcatcttaaaagcaatagaatgaggtaagtcactagcattgcagtcttctgaggatttgcatttgctggaagatggtgctgggtggagagcatctaatgtgataatgtgaggcagggccatgtacacgatggaagatgaacaggctttcacgttatcaaatggcctcacagcagcaactcaaactattatctgcttaccagttatatcacaagaggaatttagcttctaggttttgttgttgttgttgtttgttttggcttggtgccctaccattcttacagacttaaacattgaaaagctttaaatagtttatttcttatctccatctgtgaagcagccattagacttgtgaaggatgtaaaaaccaagcccccccttttttttaatagaagaggagagtgaagctgacaattaaatatgcagtcgcttatagtgtttgctgcttacagaagcttttaatccatgtaacagaatgttgagatgttcattctgtgtttaaatgtaatattccctagatgtatgccctttggcaatttagttctgctaagacctgtctgtttgtgaaggtcaaatgaaatcatgaatggaaagtgttgagtacagagcctggcaaatatgccctggagttgcatgactaggccatttggaagagttgacgggtgtgtcctatggtcctatgttaaggaaaccttaagtttaacgttgatagcctggtacagtgtactaatggcaatttttttctttgcccttccctgtttcttgttaccctctttctggtggtctttgcttactatcaatcattagtgtgtattgtgggtgtgtctatttcttgttttatgtatctattttttccttggtctgtgtgtctaattctttgttacatctatttcttccttgctttgtgtgtctatttcttccttgctttgtgtgtctatttcttccttgcattatgtctaattctttgttatatctatttcttccttgctttgtgtctatttcttccttgcagttgtgtctaattctttgttacatctatttcttccttgctttgtgtgtctatttcttccttgcattgtgtctaattctttgttatatctatttcttccttgctttgtgtgtctgtcttccttgctttgtgtctatttcttccttgcagttgtgtctaattctttgttacatctatttcttccttgcttttgtgtgtctttctttcttgcttttgtgtgtctatttcttccttgcagttgtgtctaattctttgttacatctatttcttccttgcttttgtgtgtctatttcttccttgcattgtgtctaattctttggtatatatatttcttcattgctttgtgtgtctatgtctccttgtgttgtctaattcgttgttgcatctatttcttccttgctttgtgtgtctatttcttccttgctttgtgtgtctatgtcttccttgctttgtgtgtctatgtcttccttgttttgtgtatctacttcttccttgtgtgtctaattctttgttacatctatttcttccttcctttgcatgtctccttctttcctttgtgtgtcttttctgtctgcagtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgcagtcacaccttgagactacagctctcactttagctgggaaaaacatcaaggtgtagaggaggcaagttaaataaaaagttgctcccctcctcatgggcatgcttggtagagtggaaataataaaagaggttctctatttcctcggttccacacattgcagaagatgctactggatgctaagtgcaacacatttgttccaaaagggcactcagtgtgacttacagatgccccggaaagcagagggatgctctttattaaacagaaatattagctcaaacgttttctagactgaagaacactttcctcatttcccacagtttgcctcagaggttgaatacaggaaggttattattcattcatttgctttattggttcgcctgttctacaaggatttgcatgtctcttaggccttcacttggctcctgagacatggaaaaaggaaacatagacatagggaagtgctggatggggggggggggtctcttttctgggtagtggcacgacttagtccttagtccccaagtaatatgcaatgtgagtcctcatcctcatgtcttctccggccactgcaatgagtgggaagctgggctttgtagcaagcctgaccctaaagttacagaagccctccacgctaagaaactcaattttctaggccattttagctatgactgtgaccactactggtcaggagggatgacagccatctaagttccacaatcttaggctactttgcattatcctggggcaaacaagccatttttgagctgcagcaggctttgaaatacattgaccaattttgcctgtgttcgttaaaccttttacctttttacatgctaatgctcacagtaatttagaaatgttctccttactataatatactcaaggtggcttgctatggtaaaataatgccagtggatgaaaataacattaatgtttaacattcttgcataaaatttaagaataataaaattgacaacaatcagaaaactggaggaacgaaagaccaaattgaaagaacttgaaaaagattaaaaatgcctgtgctttgaccctttccatttttctttcactcacagagggtgggacaggaggccgagtgaaggaaagggtccagcctgtctatctggaatctaagttgggactttaatgcagttccacaaaattggtattaattcgctaaatgtttctgaaaatgtattttcatctaaatggctatcagctaagccttgagtcaaatgggaatgaaacagattaagtcaatgtgatctctttatccaagttgccttagagctgaagtcacaatttgctgtaaggaagcttattcattgtagcatacgcatactttcaaagtatctagactttacttagtaacccaatcaggacattcaggcaaaagaaaaggaacagagaagatggagccaggttgaagaggtctgggagttcaaacaaatttttttcattttcattaaaactcaattgggcatcaaaagtgttactaatattagcttttaattagtggaaattggctggattcagtaatatccctttgtatgggtaggaatgggcttacatttctggaatttgcaaaggaaaaaataactgaaagccttcctttcacagttactgccatcaatattgctaccaattaagcacatcctaccatcatctgctttgatcacataaatgaactgtgtaccaatctgttgttgaaagactggagtcatcttcccaccaactgtgaaaaaacacatggaaaacacctggactttgtgaacggatgcggaatacagaacttctgttgactcttgggtgttttgaagacttgaaaaaaaaaactgttgcttaccaacatgtcacaatgagtccgtgtgtgggtgggtggatgggtgggtgggtgggtgggtgggtggttgagtgggtggggtagtttgctgttaaataaaatgctttgttttgaaaacatcatgtgctgtatatgatattttccttaaattttatttaatgtgcatgagttttgtctatgcattaggtttgggtgttatacccgtgtaggccagcagagggtgtcggatcccaaggaaaccaagttacagacgccatcttgtgtgtagccggaatgtaattcagatcccctggaagagcagttagtgctcttaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtatcttaaccactgccacattccccttttcctttgcatggagccagaactaggctagcctccaagtccctaagtagccggaatgactctgagctcctgatcctcctgtgttagaattacaggcttgtaccactaagcctgcttttcagatgatagtttctaactcagtggcccttttatcataccagatacctcagttttaattccctatgtaatgaaattggttatgttgccctggccatctggctagcctgaagtccatgtagattaggctggccctaaatccatagagcactgtctgctactgactcaggagtgctcggattaaaggcctacaccaccaggcaggcctagccagttccttgggtaatttgaggtctcataacttagagcctaagttgttcaggagaaagattatgagaacacaaatctaataagatcacgagaagcaaaatattgaggctcaaaagtgggagtactggtaagatgaaatgaaaagaaagaacatggctgtcaagaagtccttgaatagagaaaggggcctctgatagttctaaaattcaaagtgacaaaattgcgtctaggagaaaagataaattctctcaggagagagtttgtactgttagacatggctctgcctagccattgctaaccagtagaagtgctccaacaaaaccgggccttcgtttccatccaatgaatgggccagaaaagcaacaacattttacctgaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtaaatcttaacatctttggaaaatagcattggcccaactccaagaagcccatgaaaccttaccatttattactggcaactaaaggattgggacacagggcactcaaacgtatccactgatgagtatttaatagttccaaactatgtctggggtgaactatgaaacactaaacaaaataaaactagcaaatatgacagagacattttgtaaggaataaggggtgctggccagggcgggagggaaattgaaagtggaagagtaagcagaatgcattctatatacctatgaaaaatttctaataaaaaaccctatttaaagccgggcgtggtggcgcacgcctttaatcccagcactccagaggcagaggcaggcggatttctgagttcgaggccagcctggtctacagagtgagttccaggacagccagggctacacagagaaaccctgtctcgaaaaaacaaaaacaaaacaaaagacctgtctgagctggagagatgatggctcaggttaagagcactggatgctcttccagaggtcctgagttcaaatcccagcaaccatatggtggctcacaaccacctgtaatgggatctgatgccctcttctggtgcgtctgaagtcagcaacagtgtacttatgtaaaacaaaatgttttaaaaaatagaaaggaagaaagagagagagagagagagagagatgctctcataaacaacgtggaaggccagatgcacacctgaagttgtcctctgactccattatgctctgtgcaaccctcacccacaaacgtgtacacacaccatccacattcatatacaatacgcatcacacaaaagaaggaaggaaggaacgaacgaaaaagagtcaagaggagggctgccagcatccttgccctgatggctagggtcgctgcacgggtcagcagcactggactccctcgtctgactgtcaccctggtcatttagaagccaaacactgcgattcttcaaaggcgggatctgggctaagtaaggatgtggctcagtggtagagggacagccagggcctcgaactcagaaatccgtctgcctctgcctccggagtgctggggattaaaggcgtgcgccaccacgcccggctttaaataggattttttattataaatttttcataggtattgaagaggcacacatgagccccttcatggtttgctagaataaatgctcttggtgatataacttggtttcctcagcctgggttcctcaactagaaacaggcagttaaggtccaaggcatgagttgtgagctgcccgggtcttccaggcaacctgcaagtgacaggttcttgctatgcatgggcatccttattccccctgggtgaggagctttggaaactcaggggcagggagactccttctgaggcttctggaaagagagaatagatgtgaggatcaggtagaagttcccagactgtccctgccatccaagagggaggcaggagctgggctgggtatgggtcacaaagccagcagctgctagcactgagggtccttgcctttctgtcccatggcccctctcccatctgcactgtggttgcagagcctgagccagcacttcccccgactggagaatgacagaggcagagtccactcctcccattccggggcgggaagccaccatgttgcacctgggcccagcagggcctgggaacacgaggagcccacggcacccaaagccctcccctcaacccaggtccttgcgcaaggtcaggagagggcaggcaagtggccattaaaactgccctcccggcacaatggcacagtgaggtgaagctggcacaagaataaagaagaggaagaaatagagctgtagatagaagagacagcaacgtgtaataacatggcgccttcaagggtcaggaagggctattctgcaagtaatctcaggttaattagttcctctgtgctttactcgaaccaaaatttgtctcctatcagggagagaaggtggagtggataagattaaactaagcacacacagagacaattgtttttgcttttgtttttctttcatttttgagtcagggtctcacattgcagtcctggctggcttggaagtctctggcatactgctggaaacccaagcactcaccctaaccaagcactcaccctaaccaagcatgcaccctaaccaagcactcaccctaaccaagcactcaccctaaccaagcactcaccctaaccaagcacacaccctaaccaagcacacaccctaaccaagcactcaccctaaccaagcacacactgtaaccaagcactcaccctaaccaagcactcaccctaaccaagcacacaccctaaccaagcactcaccctaaccaagcacaaactgtaaccaagcactcaccctaaccaagcactcaccctaaccaagcacacaccctaaccaagcacacaccgtaaccaagcactcaccctaaccaaacattcaccctaaccaagcactcaccctaaccaagcacaaaccctaaccaagcacacaccctaaccaagtacacaccctaaccaagtactcaccctaaccaagcacacaccctaaccaagcactcaccctaaccaagcactcaccctaaccaagcactcaccctaaccaagcacacaccctaaccaagcactcaccctaaccaagcacacaccctaaccaagtactcaccctaaccaagcacacaccctaaccaagcgctcaccctagccaagtactcaccctaaccaagtactcaccctaaccaagcactcaccctaaccaagcacacaccctaaccaagtactcaccctaaccaagcactcaccctaaccaagcatgcaccctaaccaagcactcaccctaaccaagcactcaccctaaccaagcactcaccctaaccaagcactcaccctaactaagcatgcaccctaaccaagcactcaccctaaccaagcatgcaccctaaccaagcacacactgtaaccaagcacacaccctaaccaagcactcaccctaaccaagcactcaccctaaccaagcactcaccctaaccgagcatgcaccctaaccaagcactcactctaaccaaacactcaccctaaccaagcatgcaccctaaccaagcactcactctaaccaaacactcaccctaaccaagcactcaccctaagctcagttccaatagaaagaataactaaaagaattctgtagacaagggagggctttctaggtttaaaattaatttactggtccctaaaaaacaaacaaacaaaggggctggagaaatggctcattggttaagaatgctggctgctcttccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgccattataacatcacatacacgtaagattttgttcctattcactcccattactctctttttttctccctctcacttttactgatccccttactctgctcacacacttctgatttctggtttcttctatagcatggatgaagggttatttacaggaacatggcagattcttaccgaagaaagtatccccccctcccaactccctcagcaaacaataactactaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcagatcccattagggctgatcttcaacaatcacacaatcacatattcttttttgtttgtttgtttgtttgtttgtttttttgagatagggtttctctgtgtagctctggctgtcctggaactcactctgtagaccaggctggcctcgaactcagaaatctgcctgcctctgcctcccgagtgctgggattaaaggcacgcccagccaatcacatattcttatgactcagagctaaaagtctgcacgaacagaaactagtcttaccaaagctgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcagcttggcctgtgagtaaatctgtgggacattttctcggttaacgatcgactgggggggggggcagtccacttaaaccatgtgggtggagccacccatggacaggtggtcctgggaggtatgaaaaagcaaagtgagcaagccatggggagcaagccaggaagctgtcctttgtggttcctgccctaatttctactgtgatgtggaagtacaagccagataaatcctttcctacccaatgtatttttggttagaatgttttatcacagtaatagaaagcaaactaaaaactaaaacatctttctaactttcatgccacagtttctttttcttcctttcttttttcttttctttcttttcttttcttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttaaattaaaaaagttgaacctaggtgtgttgtctcgtgcctgtaatgcccatgttcaggagagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacaggcagacacggtaacagcctcttcatgcatgcactagctcacacacatgagtgcgcgtacatcacaaacacaagcacacacaataaatacatttaaaagttttcttctttctttgtaagtgtgaaaattacaaattgtagaattttgatccagataagaggatcaggagtttgaggctagcctgggctacataagaccctgtttcaaaaaccaaactaaaccaaaacacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattccatgcttgtttacgaacaagacaagtaaaatttctcgagtctctgtctcttggaataggtctttccactgtaggtgggagggaaatgtttccgtctcccaagtgctggaatttaaaggtgtgggtctggttgaactcgttttttgtgtccttcagtggtcaggtgccccggctggtgggtggggtgggaggaggagtatctgtctctattgttcctggactgatcctgaagtgtaacggaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccgtcctgatctacagagagagagagttcaaggacaaccagggctatacagagaaaccctgtctctgggggggaaaaaaagcaaggaaaaaaggaaggaaggaaagaaagaaagaaatgaagagaaagaaaaaagactaataggtcccagagactcccatgacagtgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgttacatgctgccacggtcctccctgtcactgctgccattgggctatggcctggtgtctgtactcaaactgaaaacttgcaagctagcacacgtgctggcggagtgtggacgcacgggtacacgtgcgcacgcatgaacacacacacatgcacacacgcgtgcgcacagacacacacacacacacacacacacacacacacacacacacacacacacacattttgcgcatgcgtacagatatgtgcgtgcgcacacacatacaggcacacgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacgacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagtttgaagccagcctggaaaagatggccagattatgactgtttttctaaataataagtaaagaaataaagaaaaggagaataacaaccaagcatggtgataaattcgtgacctcatcttctatgtatatgatgtaaaagtcatgaagtaataacctcttacaatattcaagtagtagctttacttggaaagaaagattttaaaagaaattttattttttagacagtcaaaaatataattaagaagtatcgtatctgtgctaagcagacaatataaaattcgggaacaaagaacatatatctttatctgtttgcttatttttatttatttatttatttacttacttacttacttacttacctacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccatcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacaaagtgagttccaggacagccagggctacacagagaaaccctgtctcgaaaaaacaaaacaaaacaaagagtactgactgctcttctagaggtcctgagtccaattcccagcacctacatggtggcttacaaccatctataattccagttcttagg

SEQ ID NO: 3 - DNA, 82845 bp, Homo sapien
cggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtgtagcaatggattataggacatttaggtcgtacaggaaaagatggcggctcaagttcttggtgcggtataacgcaaagggctttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacggatttgcttacttgttgaattcattttaattacctttagtgaattgttactttggagtccttaaagttttcaataatttttttggcagatgatactcaaattacttggcacttaaatgtactttctttcaaactcatccaccgagctactcttcaaatttttaagtcttataacacagatactgttaatgtaaagtgaacattatgactggatgtcaggagtatttgaggttctataccagttcaggctttgcttttgttgctattgttgatgctatattgactaatggttttacttgtcagcaagagccttgaattgtaatgctctgtgtcctctatcagacttactgttataatagtaatattaaggcctacatttcaactttctgtgtgttcttgcctttatggcatctagattctcctcaagactcagcaaatagtgctgctgctattgctgccccagccccaggcccagccccagcccctgccccagccccagccccagcccctgccccagccccagcccctgcccctgccccagcccctgccccagccccagccccagcccctacccctgcccctgcccctgccccacccaaccaacccaatccagtccagccctgccccagcccagtcctagccccaggcccagatactttcagacctatcccaagcccacttctacttagagaaattcgaatcttcattgattcagtgctaaaatgcagtgtccatcactcagcctataagactgagacagcccatctataccccctccatactgacttctagagtcatggaatttcacttaatgcatagaatcgtattgctaaaatgcagtgcccatcactcagcctataagactgagatagcccatctataccccctccatactgacttacagagtcatggagtttcacttaatgcatgcagtcctattgctaaaatgcagtgcccataactcagcctataagactgagatagcccatttataccccataccccctccatactgacttctagggtcatggaatttcacttaatacatagaatcgtattgctaaaatgcagtgtccatcactcagtctataagactgagatatccctatgtataccccatactccctccatactgacttccagagtcatagaatttcactttgcatacggtcctattgctaaaatgcagtgtccatcactcagtctataagactgagatatccctatgtataccccatactccctccatactgacttccagagtcatagaatttcactttgcatacggtcctattgctaaaatgcagtgcccatcactcagcctataagactgagatagcccatctataccccctccatactgacttccagagtcatggaatttcacttaatgcatgcagtcctattgctaaaatgcagtgcccatcactcagcctataagactgagatagcccatctataccccataccccctccatactgacttccagagtcatggaatttcacttaatgcatgcagtcctattgctaaaatgcagtgcccatcactcagcctataagactgagatagcccatctatacccactccatactgacttccagagtcatggaatttcacttaatgcatgcagtcctattgctaaaatgcagtgcccatcactcagcctataagactgagatagcccatctatacccactccatactgacttccagagtcatggagtttcacttaatgcatgcagtcctattgctaaaatgcagtgcccataactcagcctataagactgagatagcccatttataccccataccccctccatactgacttctagggtcatggaatttcacttaatgcatagaatcgtattgctaaaatgcagtgtccattactcagcctataagactgagatatccctatgtataccccataccccctccatactgacttccagagacatagaatttcactttgcatacggtcctattgctaaaatgcagtgcccatcactcagcctataagactgagatatccctatctataccctctaccccctccatactgacttccagagtcatggaatttcacataatgtatagatttctattgctaaaatgcagtgcccataactcagcctataagactgagatagcccatctataccccctccatactgagttccagagtcatggaatttcacttaatgcatagaatcgtattgctaaaatgcagtgcccatcactcagcctataagactgagcccatctataccccataccccctccatactgacttccagagtcatggaatttcactttgcatacagtcctactttacttgtccatggacaagtaaacaaagaactcttgtccttcatgttaatcaagatacaccaatcaaacaagagttttatatcagagacttgccatggaggtatcatctctcaagtctcctttcctttaaggaaagaaaaccattctgtcattgctgtagtagtcacagtcccaagtttctaagcagtgttcagtcgtcttttctcatgtattaccttgagtactgaataattctgtcagaaatattttgtccattggattagactttagctagtccagccctgtgtgcatttagcaaaggggcaaacacaggtctgttatcagacagttaaagtgctcagtcccaattttcaaggcattggccattaaagggggtagaatactatatactgttggcatgctgtcatgggtgctatcgccccaggtcacatctttctaactgatggagatacatttatttgctcatgatattgtatactagtctcacatgctttcttatttcagccaaaaacctctgcactggaacattttatgtggataatcctgactaggaattgagtcttttctcaaggtcctaatactacccttgctttatgtaaagagggtgctgattacttaatgcctcttacacaattgtgcaaaattgcagttgttcaagtccccttctgttagtaaccaagatcccataccctcataccctaatgggtgacaatcaagggtgccaaccaatgagaccacttctctgttctggtctttctgctgtgctggggaatcaaaccttgagtcttgtgtacgctagtaaagcactgtcatagagctacagccccaccgtgtggtggtttgagagaacagcctcttatgtagcctgggctgggcgggacttacaggcattgccacctgtaatgtaaacatatttgtgcctgttgtgtgcacagctgcatttgtccctcttcctaagcattggataaagaaaccaaactaagtcaagtcattttgttggtaatcaagaagacctttgatctgtcctgtttttaacttccaggctggcctggaacttagcatataacccaggctagccttgagctcaggatctagcctgcgtttaacaagtgttggcatatctggttcctaccactatgccctgcatgcagtctttcatattgtgaatgtgcatatgtcatttcactgtagtaatctgcatctggtgaagacttatttgtattgcagcagtatttaagatccttaacatagtaaatgtgcacagtgttaactctattgtacatattctcatgtccacagttgtgccttttagatcaggactcctgtacttagcaaagcaaagaggctcactaatataaagcttctttcatgagactatagattgaaacgattccaatacggtcaatggtccttcaaggtaagacttctgtctctgatcattcatatcctctttgctttatggaattatgtatgtgctgtgcacttgaaaccccttcctcaaactatttatgtacatactggcaattttagtaggatcaattttactcttaactttgaagtacagaagtggtgttgacctataaggtcccattttgtggcttgctaataataatgactgattgtagtaggccttttctgttcactacagaaggaaacctgaacagcgtaaaactgtaatggccataaacatgtaccttgcatattagtatgcatttactgcacacatctcattccatttggatacgatcctactctcaaacccttttgcagtacagcaagggtcactaatcttttggcttcttcatcttcctggacactggataaggctgtcccctcctttccactctttaatttccaggactattactttaaagacttaatatttgcataaaggatggggtttttaattgataacatgtcccttgaacattaatgtatataacagggacatgatccattcattttaataaaaatacttggccagttaatgtgtaaaattacacttatccacaaccttattacttttcggaccattgtatctcttgcactcctgcaagggataccgtttatctcccaaggtccctgctagtggaccattaatatacagtgaatcttcctttgtctttgccagtaaacaaaggccatactccttcgcctttcatttgcactatatcaggatatgctgatcaacaaggccgcattcttttggactgttatcatatattaaatgtatgcgtatgcactgccacctgctctgtgcacttgaaaggatcccactcacttccttagcaccttcagcaggaagtgataataagctcaagactttcatttggaaagttcacatgtctaagcacttctctaagaactactgtaccctcttctccgctttaaagcagaaagagggttgtacgaagtgctcttcatttggacttaagtgcattaatgcagttagttgtccatcattacctttggagttggattttacatccttgtactcttttgacaccagaggcatattaattatttctgagcacttctcttgtcaatattaatctgtacccttacacatatgacctgtgcggcagcaaaggttctgaaatgcctaccttttgactggggctgctgagtggtagtaactattagtaacctcagcatttggatgattactatgcaaaaatgtcaaggacctgtgtgctctctttgcataccatcaaggctactgagtcccagaattaattgctaagttatgcgtatttataactatgaatgtctggaatattttgtcccctttacattattgcagaggttgctgagcccccgaaactacccggtactgtcaatgagcacaggggctctgacgaatgacctgctctcttccttaaactgattttgggactcttaataggcacaatggcagttctggatggtttattttctactccaacttgagcaaatcccctgctagtttcccaatgatataataaagtacagcagtatgtacacccaacaatgacccggatttcgaccctttttgcattgctttaatatatacaatcctaaatagtcacaatctcacactttatagtgttccttttgcccggcctctagtttgtccattgaccacttttctgaatcactaattctcacaaacccatcattaaggaagagtttgtgccctttctcaattccatcatgccatcccttttgcctctttgtttgaacagtattgactgggcaaagcccttctcttgacttaaagtcaacaacaccagtttactcacttcatatggctacagtgtctcagttgccttctccttgctcccactgaacagagacacctcgaattcttacattattctgggtaatgttaattaccccaaacaccctatgtgtcattaataaattttggtgtatttatacactgaatagcaaaagcaggccaaaactaggtggatgagccttcaatctttaacttgcacttctaaattattccaattccaactgctggcacattctagggccaggaaccattcttgcctacctttattaatgctttattgtgcaaaatattgcaggcaagtagctcagggagttggattgccaccttttacttggggctttcctttacagtatgaactgaaaattgtcttcctgagaaggaagcttagcacttttctttccattcttcctccaggaaggagccaactgtctgcttaagaaactttaagcccgattttgtatattgctactgtacaggaccaactgccagaaaagttattgataattttattccttaagaaaggcatttggattgcaaggtggattgactgtgagatcattagcttttgtgaagtaaaaatagccatttgtgtcatgtttctgaagactaagcagtgtctcagtgtactgagggtgatgagtctgtggaaagatcagtgcaactattgcagaatgtttaagacaagtatctttgcttggtctttactacaagtttaacaaaacgaaaaagtcaatctttgtgtggcctttagtatgattaactttttggaagatgacctaagccttctaatcattatattttgtctgacattggtcaccagtccttgcttatttttaaaaggtgactggatggattaaatttgagaacatgtcaagtcgcctttgaaaattatataggccatcacatttaattaattcattctatccaccattaaactctggcaataatttgaagtagcttgaaaattcctaaagtgggaatttattttagagatgatagaacctgtttccccactttacattttaaaatatgtctgccaggatctaatcattcctttaaacgtacacttcaaagagagattttcctagtaagaaaagagctttctctagtgtgaagggtgctttgtagccgccgagtacttaggtcttttttgggagctattgtgtatgagtgtatgtatgtgtgtgtgtacatgcatgttgctgcgcgcagtcattcattcacatggtgctcagacaacaatgggagctggttcgtctatcttgtgggtcctggagatcaaagtgagatcatcaggcttggcagcaagtgcctttaccctccgcgtgccatcttgccatcccgctgctgagtgtttgatatgacattgctgatgaaaataatcatcacaacagcagttctcccagcattactgagaaatgatactatttttctgaggaggatgttcaagtaactcatccagtgcaggatcctgcttgaactactgctcctccgttacatcagactctggctgtttagactacagtaagtactaccttgttagctactaagctatctttttctcattcgagtttctttctgtgccacccactgaaaagtcaaagtgactaataagtcactagctcttctcagcttatccatacacaacacatagtatgccaacgaaattgtagaattaacacattgtgtacccaatcgccattatgctggggtacactaaaatgagaagcgatgatattttacaaaatttcttccgtgagatgattatgttatttaagacttaatgtaatataagcacacttgagatcattttaggaaatgtactgcctgtgtgaattgtttaagtattttaggaagtctactggggttgaaatttgacttcttaaagagggaagtgtgcttactttgccttgttggtccagacgactattagtaccatctggttggtttatctgaatgccatctgtttctatctacctcttggaagcatggaaagaatattaagagtgaaagactccatgcattatgcttagctgtacgccaagggtagcaagagatgagcttgtgtaggaattgggaatataaatttgataatttggttctttcaaccatttttactgcatttctgcccagaacagaccactggacggcactaacagcttagacagagaacttcatagcttacaatctttttttttttttttttttttttttttttttttacaaaagtgcaaagaaggataagttttatgaacaaattttactatggactactttatgtaccctccttgctcatttttctttttcattaattaatcaattaattttgttttgttctctgttttgttttgtgacagggattctctgtgtagtctggctatcctggaactcaaactcaagagatccgcccgcagagatccgcccgcctctgcctccagtttagagtgttgggattaagggtgggtgccacactggacccctgccagcacttttcaacagatactttcagttaaaacaacaaatacttgactcctgtgtagaaaatggtctagctgaaaaaacatccttgtccataacacttaacatttttttgcatttgccttttgtacgtgcaaatgaccctctagtactttaacccttttaagtccactgtaaattccttcgcagcaggtttcccccaactccaaaggcttagcattgtctggctctctaggtgataatacatctagaactattgagtcttttaggaaactaggaccattgttgtacaagtaactgcttcaaaaggaaacatttgcaaggaaaaaaagctttttgagatgctaaagaatgtgtttggtgcactaagacagttagctaaagcttcggtctcaccttagcaccattggctacccaccccagtacatgcaaagtgaccccccccccaggcttgcctaggcacctagagctttcagcctgcctcctatggacctaaatagagattaggactcagactccagttagtggcctggaggaagctggtactgctgctattcacagtaaacccactatcactgacagttccctattgaaatgatcaagttgtgtgagcaggcagatcattaatcagggccaattctgtcatggcaacctagtcctacatgacctccacggcactgtaaaatacacacttatttgtagtaggacatctggaacatgagcttgtctgtgattgaaatgtccattaggaggtgccatcacacaaaaccatctggaggccatctttggtccccataattgatggaatacaaagagttccccaaattagtgtcctgacccagccctcactgtcagtaatcatgtaatggaaagccaccaactcgccatcaccatcttcaggctgcctgaactgtatacattaagaatgagctttcagccgggcagtggtagctcgagcctttaatcccagcacttgggaggcagaggcaggcggatctctgagttcgaggccagcctggtctacagagtgagttccaggacagccagggctacacagagaaaccctgtcttgaaaaaaaaagaagaatgagctttcttccaagctgtccaatggcttgacccagacttaggagtttgtaaacaaagaaccctgtagaacaagtgaatttgagaatgtacaccttcattaagtggtgggaagtggaagtagtggattttgccagctgattttacaaagccctgtggcagaaccagaccaggtctttgtatgcatactgccatataacctagccactgtccaacctgtgccctctctcccagtccagtgaacctcttctgcctgccccttacttagtcctctggctcatcccaggggaagatggctctatttgtgtagtcataagaaagttttgttaattttaaataaaacaggaaaagagaaagctcacttaagacgagagctggagagatggttctgttagtcttccagaggtcctgagtacaattcccagcaaccacatggtggctcacaaccatctgtaatgacgtctgactccctcttctggcacacaggcatacatgcagatagagtactcaaatatacaaaaagggaaaagaaatgaaaggcctttgaaatgtagacatgctttcaattttaaaggctgttttcacatctcttaagaactaggggttccatgagaacatatcctcaccctgagttcttaccaccaattgaaaacgctgacatgtgcatatgaagattgtattgctagtaatcaaattatcatttgtagagtttagtataattatcatttgttttccagggatgaatttggagtctgttttgtgctcctgcctcaagaagaaggattgcctggatttagaggagtgaagagtgctggagagagcccaaaggtatttccgttacttggttgactgagatagtatcttcccttaaaggtctaatgtgtcaagttatacctcctaagtaaatacctcattattttcatgtggaattttcaacaatttttgtagtctaatgatagccttgtatttcttcacagggacaaacaatccctatgtgagactcaaggactgccagcagcctatacagctacattacatctcagcagaacttctcttcaagtcctcgctactctgaacaaaaagcttacaggccacatggagaaaaaaaggtactttggagaatttgctatttgggggtttctatctgatctccagttcatcagagaatgagggggcaagtcaataaagcactccccatctcctggtcccctggcatagtcagttagccaatgagatccttgccttatgatgaggccttgaaatcatccccaccatgttatgaccaatctgtaacatttctgctctgaaatgcctaaaaggtaggttatcagaggaatgaaggccagtttctgacaccctagtcttttgtacttgatagagtaagtagatatggctgttgtcacattctgtaggcctgtcataattctggtctctgaatatcctcaaactcagaggtccaatgctacaccagtttctagggacatatgcaccataagcactgagccaaacaatgctattcaccttgccagtgttctggcatggtattgtttaaagcacaaattaaaagaagaaaataatttaacccctttattcccagagtatttgaagtacaaggactttaacacaacctataatctaaaggatctctcattggtaggtgacagaataaaagccagaaagaacttggatggagcaattctcatgtctctaagttaacactaagatctacaaatgtgaagggttcactctccaagcccctccccatgatttaacacaactgctggttactacataatgagacaactttcccagtattcttgatttcaagaattggcttttctttcacctcttttccagatctccccccagaattgtgggcttgctgctttgcagtgctggcgacctattccctttgacgatccctaggtggagatggggcatgaggatcctccaggggaatagctcaccaccactgggcaacaggcctagcccagatttcagtgagacgctttcctgaacccagcaaggaagacaaaggctcaaagaatgccaccctacatcaaagtaggtaagttttctgcaacagtgtaataattttaactttgatcttgttttccattaaagtcagccttttacttgagatatatacataaattttatctttttcccacatctgggaaatgtaactaaacagtgcaaatgtttcttctaggagaaaagctgctgcaatagtggcactgaccttcgaggaagccattctgctctatttggttctctctccagaagctaggaaagctttgccagctgtttacatacttcaagatgcactgctaccctactcatgccatataatacacaagtgagtagcttatttacctacctagctatttacgagtacactgttgctgtcctcagacacaccagaagagagcaccagatctcattacagatggttgtgcgccaccatgtggttgctggggattgaactcaggacctctggaagagcaataggtgctcttaaccactgagccatcactaacattactgatgatgaatgcctctaactacaaatggaaacctggctggaattgatacagaagtatctatcattaggcagaatttaaagagccaggatgttctagtacttctttcctggcattcatacagcttcttttgttctttgtagtgccatctaccaaatattacccttccccaaagcagcacagaaaactgggtcttcagcgtgatcaagcaatgtgaacacacaaaaggaaggcagctttataaatgacccgaggatcaacatgcctgactgcagcatcttaaaagcaatagaatgaggtaagtcactagcattgcagtcttctgaggatttgcatttgctggaagatggtgctgggtggagagcatctaatgtgataatgtgaggcagggccatgtacacgatggaagatgaacaggctttcacgttatcaaatggcctcacagcagcaactcaaactattatctgcttaccagttatatcacaagaggaatttagcttctaggttttgttgttgttgttgtttgttttggcttggtgccctaccattcttacagacttaaacattgaaaagctttaaatagtttatttcttatctccatctgtgaagcagccattagacttgtgaaggatgtaaaaaccaagcccccccttttttttaatagaagaggagagtgaagctgacaattaaatatgcagtcgcttatagtgtttgctgcttacagaagcttttaatccatgtaacagaatgttgagatgttcattctgtgtttaaatgtaatattccctagatgtatgccctttggcaatttagttctgctaagacctgtctgtttgtgaaggtcaaatgaaatcatgaatggaaagtgttgagtacagagcctggcaaatatgccctggagttgcatgactaggccatttggaagagttgacgggtgtgtcctatggtcctatgttaaggaaaccttaagtttaacgttgatagcctggtacagtgtactaatggcaatttttttctttgcccttccctgtttcttgttaccctctttctggtggtctttgcttactatcaatcattagtgtgtattgtgggtgtgtctatttcttgttttatgtatctattttttccttggtctgtgtgtctaattctttgttacatctatttcttccttgctttgtgtgtctatttcttccttgctttgtgtgtctatttcttccttgcattatgtctaattctttgttatatctatttcttccttgctttgtgtctatttcttccttgcagttgtgtctaattctttgttacatctatttcttccttgctttgtgtgtctatttcttccttgcattgtgtctaattctttgttatatctatttcttccttgctttgtgtgtctgtcttccttgctttgtgtctatttcttccttgcagttgtgtctaattctttgttacatctatttcttccttgcttttgtgtgtctttctttcttgcttttgtgtgtctatttcttccttgcagttgtgtctaattctttgttacatctatttcttccttgcttttgtgtgtctatttcttccttgcattgtgtctaattctttggtatatatatttcttcattgctttgtgtgtctatgtctccttgtgttgtctaattcgttgttgcatctatttcttccttgctttgtgtgtctatttcttccttgctttgtgtgtctatgtcttccttgctttgtgtgtctatgtcttccttgttttgtgtatctacttcttccttgtgtgtctaattctttgttacatctatttcttccttcctttgcatgtctccttctttcctttgtgtgtcttttctgtctgcagtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgcagtcacaccttgagactacagctctcactttagctgggaaaaacatcaaggtgtagaggaggcaagttaaataaaaagttgctcccctcctcatgggcatgcttggtagagtggaaataataaaagaggttctctatttcctcggttccacacattgcagaagatgctactggatgctaagtgcaacacatttgttccaaaagggcactcagtgtgacttacagatgccccggaaagcagagggatgctctttattaaacagaaatattagctcaaacgttttctagactgaagaacactttcctcatttcccacagtttgcctcagaggttgaatacaggaaggttattattcattcatttgctttattggttcgcctgttctacaaggatttgcatgtctcttaggccttcacttggctcctgagacatggaaaaaggaaacatagacatagggaagtgctggatggggggggggggtctcttttctgggtagtggcacgacttagtccttagtccccaagtaatatgcaatgtgagtcctcatcctcatgtcttctccggccactgcaatgagtgggaagctgggctttgtagcaagcctgaccctaaagttacagaagccctccacgctaagaaactcaattttctaggccattttagctatgactgtgaccactactggtcaggagggatgacagccatctaagttccacaatcttaggctactttgcattatcctggggcaaacaagccatttttgagctgcagcaggctttgaaatacattgaccaattttgcctgtgttcgttaaaccttttacctttttacatgctaatgctcacagtaatttagaaatgttctccttactataatatactcaaggtggcttgctatggtaaaataatgccagtggatgaaaataacattaatgtttaacattcttgcataaaatttaagaataataaaattgacaacaatcagaaaactggaggaacgaaagaccaaattgaaagaacttgaaaaagattaaaaatgcctgtgctttgaccctttccatttttctttcactcacagagggtgggacaggaggccgagtgaaggaaagggtccagcctgtctatctggaatctaagttgggactttaatgcagttccacaaaattggtattaattcgctaaatgtttctgaaaatgtattttcatctaaatggctatcagctaagccttgagtcaaatgggaatgaaacagattaagtcaatgtgatctctttatccaagttgccttagagctgaagtcacaatttgctgtaaggaagcttattcattgtagcatacgcatactttcaaagtatctagactttacttagtaacccaatcaggacattcaggcaaaagaaaaggaacagagaagatggagccaggttgaagaggtctgggagttcaaacaaatttttttcattttcattaaaactcaattgggcatcaaaagtgttactaatattagcttttaattagtggaaattggctggattcagtaatatccctttgtatgggtaggaatgggcttacatttctggaatttgcaaaggaaaaaataactgaaagccttcctttcacagttactgccatcaatattgctaccaattaagcacatcctaccatcatctgctttgatcacataaatgaactgtgtaccaatctgttgttgaaagactggagtcatcttcccaccaactgtgaaaaaacacatggaaaacacctggactttgtgaacggatgcggaatacagaacttctgttgactcttgggtgttttgaagacttgaaaaaaaaaactgttgcttaccaacatgtcacaatgagtccgtgtgtgggtgggtggatgggtgggtgggtgggtgggtgggtggttgagtgggtggggtagtttgctgttaaataaaatgctttgttttgaaaacatcatgtgctgtatatgatattttccttaaattttatttaatgtgcatgagttttgtctatgcattaggtttgggtgttatacccgtgtaggccagcagagggtgtcggatcccaaggaaaccaagttacagacgccatcttgtgtgtagccggaatgtaattcagatcccctggaagagcagttagtgctcttaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtatcttaaccactgccacattccccttttcctttgcatggagccagaactaggctagcctccaagtccctaagtagccggaatgactctgagctcctgatcctcctgtgttagaattacaggcttgtaccactaagcctgcttttcagatgatagtttctaactcagtggcccttttatcataccagatacctcagttttaattccctatgtaatgaaattggttatgttgccctggccatctggctagcctgaagtccatgtagattaggctggccctaaatccatagagcactgtctgctactgactcaggagtgctcggattaaaggcctacaccaccaggcaggcctagccagttccttgggtaatttgaggtctcataacttagagcctaagttgttcaggagaaagattatgagaacacaaatctaataagatcacgagaagcaaaatattgaggctcaaaagtgggagtactggtaagatgaaatgaaaagaaagaacatggctgtcaagaagtccttgaatagagaaaggggcctctgatagttctaaaattcaaagtgacaaaattgcgtctaggagaaaagataaattctctcaggagagagtttgtactgttagacatggctctgcctagccattgctaaccagtagaagtgctccaacaaaaccgggccttcgtttccatccaatgaatgggccagaaaagcaacaacattttacctgaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtaaatcttaacatctttggaaaatagcattggcccaactccaagaagcccatgaaaccttaccatttattactggcaactaaaggattgggacacagggcactcaaacgtatccactgatgagtatttaatagttccaaactatgtctggggtgaactatgaaacactaaacaaaataaaactagcaaatatgacagagacattttgtaaggaataaggggtgctggccagggcgggagggaaattgaaagtggaagagtaagcagaatgcattctatatacctatgaaaaatttctaataaaaaaccctatttaaagccgggcgtggtggcgcacgcctttaatcccagcactccagaggcagaggcaggcggatttctgagttcgaggccagcctggtctacagagtgagttccaggacagccagggctacacagagaaaccctgtctcgaaaaaacaaaaacaaaacaaaagacctgtctgagctggagagatgatggctcaggttaagagcactggatgctcttccagaggtcctgagttcaaatcccagcaaccatatggtggctcacaaccacctgtaatgggatctgatgccctcttctggtgcgtctgaagtcagcaacagtgtacttatgtaaaacaaaatgttttaaaaaatagaaaggaagaaagagagagagagagagagagagatgctctcataaacaacgtggaaggccagatgcacacctgaagttgtcctctgactccattatgctctgtgcaaccctcacccacaaacgtgtacacacaccatccacattcatatacaatacgcatcacacaaaagaaggaaggaaggaacgaacgaaaaagagtcaagaggagggctgccagcatccttgccctgatggctagggtcgctgcacgggtcagcagcactggactccctcgtctgactgtcaccctggtcatttagaagccaaacactgcgattcttcaaaggcgggatctgggctaagtaaggatgtggctcagtggtagagggacagccagggcctcgaactcagaaatccgtctgcctctgcctccggagtgctggggattaaaggcgtgcgccaccacgcccggctttaaataggattttttattataaatttttcataggtattgaagaggcacacatgagccccttcatggtttgctagaataaatgctcttggtgatataacttggtttcctcagcctgggttcctcaactagaaacaggcagttaaggtccaaggcatgagttgtgagctgcccgggtcttccaggcaacctgcaagtgacaggttcttgctatgcatgggcatccttattccccctgggtgaggagctttggaaactcaggggcagggagactccttctgaggcttctggaaagagagaatagatgtgaggatcaggtagaagttcccagactgtccctgccatccaagagggaggcaggagctgggctgggtatgggtcacaaagccagcagctgctagcactgagggtccttgcctttctgtcccatggcccctctcccatctgcactgtggttgcagagcctgagccagcacttcccccgactggagaatgacagaggcagagtccactcctcccattccggggcgggaagccaccatgttgcacctgggcccagcagggcctgggaacacgaggagcccacggcacccaaagccctcccctcaacccaggtccttgcgcaaggtcaggagagggcaggcaagtggccattaaaactgccctcccggcacaatggcacagtgaggtgaagctggcacaagaataaagaagaggaagaaatagagctgtagatagaagagacagcaacgtgtaataacatggcgccttcaagggtcaggaagggctattctgcaagtaatctcaggttaattagttcctctgtgctttactcgaaccaaaatttgtctcctatcagggagagaaggtggagtggataagattaaactaagcacacacagagacaattgtttttgcttttgtttttctttcatttttgagtcagggtctcacattgcagtcctggctggcttggaagtctctggcatactgctggaaacccaagcactcaccctaaccaagcactcaccctaaccaagcatgcaccctaaccaagcactcaccctaaccaagcactcaccctaaccaagcactcaccctaaccaagcacacaccctaaccaagcacacaccctaaccaagcactcaccctaaccaagcacacactgtaaccaagcactcaccctaaccaagcactcaccctaaccaagcacacaccctaaccaagcactcaccctaaccaagcacaaactgtaaccaagcactcaccctaaccaagcactcaccctaaccaagcacacaccctaaccaagcacacaccgtaaccaagcactcaccctaaccaaacattcaccctaaccaagcactcaccctaaccaagcacaaaccctaaccaagcacacaccctaaccaagtacacaccctaaccaagtactcaccctaaccaagcacacaccctaaccaagcactcaccctaaccaagcactcaccctaaccaagcactcaccctaaccaagcacacaccctaaccaagcactcaccctaaccaagcacacaccctaaccaagtactcaccctaaccaagcacacaccctaaccaagcgctcaccctagccaagtactcaccctaaccaagtactcaccctaaccaagcactcaccctaaccaagcacacaccctaaccaagtactcaccctaaccaagcactcaccctaaccaagcatgcaccctaaccaagcactcaccctaaccaagcactcaccctaaccaagcactcaccctaaccaagcactcaccctaactaagcatgcaccctaaccaagcactcaccctaaccaagcatgcaccctaaccaagcacacactgtaaccaagcacacaccctaaccaagcactcaccctaaccaagcactcaccctaaccaagcactcaccctaaccgagcatgcaccctaaccaagcactcactctaaccaaacactcaccctaaccaagcatgcaccctaaccaagcactcactctaaccaaacactcaccctaaccaagcactcaccctaagctcagttccaatagaaagaataactaaaagaattctgtagacaagggagggctttctaggtttaaaattaatttactggtccctaaaaaacaaacaaacaaaggggctggagaaatggctcattggttaagaatgctggctgctcttccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgccattataacatcacatacacgtaagattttgttcctattcactcccattactctctttttttctccctctcacttttactgatccccttactctgctcacacacttctgatttctggtttcttctatagcatggatgaagggttatttacaggaacatggcagattcttaccgaagaaagtatccccccctcccaactccctcagcaaacaataactactaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcagatcccattagggctgatcttcaacaatcacacaatcacatattcttttttgtttgtttgtttgtttgtttgtttttttgagatagggtttctctgtgtagctctggctgtcctggaactcactctgtagaccaggctggcctcgaactcagaaatctgcctgcctctgcctcccgagtgctgggattaaaggcacgcccagccaatcacatattcttatgactcagagctaaaagtctgcacgaacagaaactagtcttaccaaagctgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcagcttggcctgtgagtaaatctgtgggacattttctcggttaacgatcgactgggggggggggcagtccacttaaaccatgtgggtggagccacccatggacaggtggtcctgggaggtatgaaaaagcaaagtgagcaagccatggggagcaagccaggaagctgtcctttgtggttcctgccctaatttctactgtgatgtggaagtacaagccagataaatcctttcctacccaatgtatttttggttagaatgttttatcacagtaatagaaagcaaactaaaaactaaaacatctttctaactttcatgccacagtttctttttcttcctttcttttttcttttctttcttttcttttcttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttaaattaaaaaagttgaacctaggtgtgttgtctcgtgcctgtaatgcccatgttcaggagagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacaggcagacacggtaacagcctcttcatgcatgcactagctcacacacatgagtgcgcgtacatcacaaacacaagcacacacaataaatacatttaaaagttttcttctttctttgtaagtgtgaaaattacaaattgtagaattttgatccagataagaggatcaggagtttgaggctagcctgggctacataagaccctgtttcaaaaaccaaactaaaccaaaacacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattccatgcttgtttacgaacaagacaagtaaaatttctcgagtctctgtctcttggaataggtctttccactgtaggtgggagggaaatgtttccgtctcccaagtgctggaatttaaaggtgtgggtctggttgaactcgttttttgtgtccttcagtggtcaggtgccccggctggtgggtggggtgggaggaggagtatctgtctctattgttcctggactgatcctgaagtgtaacggaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccgtcctgatctacagagagagagagttcaaggacaaccagggctatacagagaaaccctgtctctgggggggaaaaaaagcaaggaaaaaaggaaggaaggaaagaaagaaagaaatgaagagaaagaaaaaagactaataggtcccagagactcccatgacagtgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgttacatgctgccacggtcctccctgtcactgctgccattgggctatggcctggtgtctgtactcaaactgaaaacttgcaagctagcacacgtgctggcggagtgtggacgcacgggtacacgtgcgcacgcatgaacacacacacatgcacacacgcgtgcgcacagacacacacacacacacacacacacacacacacacacacacacacacacacattttgcgcatgcgtacagatatgtgcgtgcgcacacacatacaggcacacgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacgacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagtttgaagccagcctggaaaagatggccagattatgactgtttttctaaataataagtaaagaaataaagaaaaggagaataacaaccaagcatggtgataaattcgtgacctcatcttctatgtatatgatgtaaaagtcatgaagtaataacctcttacaatattcaagtagtagctttacttggaaagaaagattttaaaagaaattttattttttagacagtcaaaaatataattaagaagtatcgtatctgtgctaagcagacaatataaaattcgggaacaaagaacatatatctttatctgtttgcttatttttatttatttatttatttacttacttacttacttacttacctacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccatcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacaaagtgagttccaggacagccagggctacacagagaaaccctgtctcgaaaaaacaaaacaaaacaaagagtactgactgctcttctagaggtcctgagtccaattcccagcacctacatggtggcttacaaccatctataattccagttcttaggggacattgacaccttcttctggcttctgtggacactgcacagatatggtacctaggtatggcagccaaaacacccaagcacataaaataaagataaataaatatttttaaaaagggggatgggggtggacagatggctcagcggttaagagcattgactgctcttccagaggacctgaattcaattcccagcaaccacacaaccatctgtaatgggatctaatgccttcttctggtgtgtctgaagacagctacagtgtactcaggaaaaaaatagtttttttttttttaagaaagaaattcagatatctgctgtattgtactctttattactgccaggacaaaatgtccagaacgataattcaaaaatagcccactgacttttcacgtgctagaaggtagaaagtgatagcagatttcatgccatgcagatgatccctgtttccacagaggtgcttctctcacaagacagaagaaatggaagagcaaaagacacaaccaggagtgtacttttagctgttcttacaaggacagggacagtaatcgagtcatggaggcattaccaaatacatccaaaaaggccttatctttcttgttgtttttgttcggttggttttggttttgaggcaaggtttttcggtgtagttctggctatcctggaattctggagtcaggctgacctcgaactcacaaagatcctcctgactctacctcctgagtggtaggacaaaagccgtgcaccatctgatcaccctactcatgatgtgtgcatgcacacacactaataataacaagcaaaaaatatctttaaaaagtctaaaaccacaactttgagacagacattaggtagacatacttattccaaaagtcagaaataggaaagaagaaagggataaattacgccaaataagccccagacatggcagggcaagagttcgttctgtgtgcgcacgtgctccaaagtgtttcattacagttgctttcagagtcctgggtgaggggattatttgtaggagaatggactccctacaagtagttacacactcagatcttctctccctttctcaccaactatagaccccccagggaggggtggggtaacatcagctcctcccaataggggaaggttttgttggtgttgtgttgtgttgtgttgtgttgtgttgtttgagacagtctatcactatgtagcctgattggcctggaattcatcaggtagaccaggctggcatctaaatcagagattcacctgcctctgtattttgactgctgggattaaaggtatgtacaccaacatattcccctaagaggggatggatcccagggtctagatgccattgctctctctcccctctctctttataaatatagttttaagatttttacttgtatttatcagtacagggggtgggttgctggagtatgccagaagagagtattggatcgcttggagctagagttacagggaattttgagacatctggggactgaatataagtcccctgaggagcagcaccccaacatggtaatacttcatcttaaggctcaagagcaaactttggctccaagttctgcctctagacacacggagcgccatttgggttcacagggctctaagcttgcctcgctaggcacgctgacacagcacttcttgtcagtcggaaccagttgctggcacctctcccaagctgtttttgcatactggtggctctatagctctggcgtcataactgagagcagtgttttcatagctcttttgggcattgctctcattgggggtctattctctgggcaaaagtcgctaagcactgtgctggtagagactttatatcagccttcctctggttctctgcttggctctcaaaactcatggaggaatcctttgaaatctaggtgaagctagtcatgactccacagctcatacgtttggaggcagcagttccttgctaaattctactttgtgtgcattaatgtctcctaagcaagtctagtagaaaatcctttataatatcaattgtagtacttcaagtttcttccgcatcacggcatcggctgagtaacagtcccccagatagatggaacaatagaagattacaaagtgagaaaaggaaggaagtagaaaaactggtgtttacttggttccagctgttttctgattcaggaagaaaggggccgggcatactctacccatttatagtaagaagatttttttgttttggtgggtttttcgagacagggtttctctgtgtatccctggctgtcctggaactcactttgtagaccaggctggcctcgaactcagaaatctgcctgcctctgcctcccgagtgctgggattaaaggcatgcgccaccatgccaccacgcccggcttgtagtaaggagatttaactgtaccatgtaaggcaagagctcctcatgtcagagttcaaaaagtaaatgtgctgaaccatcacttggtttagaacagcttaagcccccagcccccactccaccccaaaccaacccttgactgtttaattgctgataaggaataaaagccctttcctataaaccactgtttgtttgtttgcaacgaaatcagagatttactatatggatatttaaaaattcagaatttgggggctagagagatggcttagaggttaagagcactggctgctcttccagaggtccagagaacccagtttcaattaccaacaaccacatacagatcacagctgtctgtaacttcagctctaagggatcctataccatcacacagatatggatgcaggcaaaaaagcatcaatgcacatggaataaaaataaataaaatttttaaaatttggaatttacaaataatgaagatccctcactggttcagccactcaccgaggtacctcactccagcaatttcccctcaccagacttattcatttttaaagtttagatgtttgaatatttattgtaaaacagcaagcacaatgatttctatttttataattggtgacgtgatctggaaaaatacttctaattggtaaggcaagagtgattgcaatgcactcttcatttttttctaacttcttaaagtatcttcttttttaaaattaaaactttattataggggctggagagatggctcagtggttaagagcactgactgctcttccagaggtcctgagttcaattcccaggaacctcatagtggctcacaaccatctgtaatgagatctgatgccctcttctggtgtgtctgaagacagctacagtgtacttagatataataaataaatctttaaaaaaaacctttactggaaggagttacagagacaaagtttggagctgatacaaaaggatggaacatctagagactgccatatccagggatccatcccataatcagcctccaaacgctgacaccattgcatacactagcaagattttgctagaaggaccctgatatagctgtctctagtgagacttcgcctgggcctagcaaacatataagtggatgctcacagtcagctattggatggatcacagggcctccaatggaggagctaaagaaagtacccaaggagctaaagggatctgcaaccctataggtggaacaacaatatgaactaaccagtaccccccagagctcgtgactctagctgcatatgtatcaaaagatggcctagtcggccatcactggaaagagaggcccattggacatgcaaactttatatgccccagtacaggggaacgccagggccaaaaagtgggagtggggggaagggtatgggggactttttggatagcattggaaatgtaaatgaggaaaatacctaattaaaaaaaaaaacggggcctagcaaacacagaagtggatgatcacagttagctattggatgggtcacacggcccccaatggaggagctagagaaattacccaaggagctaaagggaactgcaaccctatagatggaacaacattatgaactaaccactaccccggagctcttgactctagctgcatatgtatcaaaagatggcctagtcggccatcactgcaaagagaggcccattggacttgcaaactgtatatgccccagtacaggggaaccccagggccaaaacgggggagtgggtgggtagtggattggggggggtgggtatggcggacttttgggatagcattgaaaataaaaaaaaacctttactataaaaaaacttgcaaataaaaaattacccaccggagctaatgaccagatctttaatagttttgttttttatattgttatagtgtttgtgttctcagcacacttaacaaaagcaacagaaaatataagaaattaatctactcaactaaactaattaaagtttattttgagacaggatctcactatgtagtcctgaactggaactcactatgagcagctggcttttaatttaaagacccacaggtttttgcctcttttgcctctggagtgctgggattaaaggcatgagccagcagcatcccagactacattttaagaaagggaaaaaagctggtcgccgggcatggtggcgcacgcctttaatcccagcactcgggaggcagaggcaggtgaatttctgagttcgaggccagcctggtctacaaagtgagttccaggacagccagggctacacagagaagccttgtctctaaaaaccaactaaccaaccaaaccaaaaccaaaccaaaccaaaaaggaaaggaaaggaaaaaacgaggtaattagcataattagcatgacaaggaaggggtagtgagaaacagtgacacagaaacgcaaaggtttcaagcagaatttattggaagtttggcaagcaacaaacaccctagttggcctgtagatgactttagattgttttgcggtgattttcattttgaagaaggatttccaattttcaaaacagccaggctcaaattaagtattttccatttattttagcagtttggtatagatttgttttcggcttagtgtgtagagatgtttgtttgtttgtttgtttgtctgttttccatcaggacttcatttatgcatgagggcacaatggtagctgatggtgacacgtttctgcctgcctgcttaatcagttgggttcatggcaccatctgtggaagaaaggttttcaattattctctatttttcagtaatgcctccctcgtgaacatctttagaaaaggggccttccaaggtctaccaagtcttatcgattctctctctgtgttttgttgtttgggaggtttttctgtgtaatggccctggccgtcctggaacctcctttgtagaccaggcagactttgaactcagagagatctgcctgcctctatctcctgagcactggcattaaaggtgtgtgctaccgccatccagctgattgcttatattaaagggcaaacatcagtgtttcagctatattagatgcctacgtgaaaaggcagtatggggctggagatgcagctggttaagttgcatgctgtcaaacctgtgagggtgcatacgtgtaagagtacttgccaatacaagcaatgctaaacagttaaatgtctgtttccttctttacctatggatgttgtcattggtttgctttgtaaactatagttttgacgctgtgaaagacagaaggcactacagaaactacaaaatccttttcctttgtgtgaaatgtgaaagttttaagaaaacttataaagaaattgcactgatttgattactaaacgtcagttctacttaatgccaagcttagccaataactatttacctcacttctttccaggaaaatgttcatggtattttattattattttaaaaattatatgtctctgtgtcacatgagtgctatatctgcccagctcttgagctgtttaaggtttactgtaaatgataaaagttgtatgttgggctagagagatggctcagtagttaagagcactgactgctcttccaaaggtcctgagttcaaatcccagcaaccacatggtggcttgcaaccacccgtaatgagatctgacgcccttttctggtgcatctgaagacagctatagtatacttagatataataataaataaatctttttaaaaacagttgtgtgtcttttatttaatttatacaagtgctagtgcctacaggggtgataggaattgggtctcctggagatgaaattataggtgattgtgagcagcttgacacaggtgctggggatcaagcttgggtcctcctctgtaagagcaatatgagcttttaactactgagccacatggttttagttctttataggagacactgttttttgttgttgttgttgttcttgtttttccccctccgttctgccaagtcctggagagtgttcgagaccgtgggtctattctatattctcagagctcaattgttctggaaagtcagagcctaagaggtaggatctcagaagtaggactggctgtggattggctgctcagctcttccctagcttctactccttcactgtgattgtagcttcagggattctggctccaggggcagcagtacagtttagtgcgatctgaacattaggaccctataaacttgtactgcttcagatcctcccagttccttcaaggtctcatttcttttttttcttgataactattactcacaatctggttcctacaggtgaaaaccttatctactccccagggatctcagctgaaccagcctgctggggctcctccttggccagattcaagagccttggacttggtttgttaacaaaggggagaggaggggctgcttatctggggatgtctgagtgggaaaggacaccagggacagtccttgagctagagtcctcccttgtggccaaagtacagtgtaatctgtgggaacagtgaccatttgtgtctcttccttacccttgatgttctttgattgcctagaccatcctcggaatgggatagggtgccttctgtctcctggatactgggattgcatcatactcggcttttgtagtactaaggactctaaccaaggacctcattcatgcaaggcaagtactataactagtgagctacatcctgattatccctccattgtcttatttattatttggttagttatttatttggtagggtctcactatttagccctagcttgcctagaacttgttatgtagaccatgttggccttgaagtcacagatacttgtcagttgcctctctgagtgctggagtgctaggcttaaaggtgtgtaccctagacctggcttccagtgcctttaaattccctgtatgtatgtcaggctgcaaggatgaaatgtgtgacttcaataacaatccaaagggcaagaaagatacctgattcagtttcttccaggtcttggtcagcttgtgggttctgatcagtgaacatctccctagaatatatagtgtaatcaattgtcaataggctaaatccaacaacttagagagacatgaaaatcattcatgcacacacatgaaaatatgacccatttatatttgaactaagacaggctatctacccccaccttctttgagacaggctcttactatatagtcctaaccagcctagaagccactatgtaaatcatgctctacgtagctctcaaaaagaaatctggaagtggcaatgtggtgaggtagagacggtgatggagagctcaaggccagcctttatcccaccagcagtctgggaggcagaggcaaatggaagctactatgtggagcaagttggcctagaactcctgcttctgcctcccaagtgctagaatgaaaggtgtgcactatcttacctgactatttttccattttaaaggaaaaaagacatcaaatgtgagcctccccctgccagagcctgacaaatacagagatggatgcttgaagccaactattggactaagcacagggtccccaatggaggagctaaagaaaggactgaagaagttgaaggggtttgcaaccccacaggaagaacaatatgaaccaaccccaagagctcccagggactaagtcatcaacaaagagtacacatggctccagctgcatacattgcagaggatggccttgtcatgcatcaatgggaggaggggcgcttggtcctatgaaagcttgatagatgccccagtgtaggggaattgagggtgggaaggtgggagtgggtgggtgggtgggtggaggaacatcctcatagaagcaggggagggaggatgggataaagggtttcgggggggagatgtggaaaggggatataacatttgaaatgtaaataaagaaaatatccaataaaaggaaaaaggaaaaaaaagaagaaaaaatgtaagcctccactagcacatgacaaatgacagtactgaaaggacagagcatgaaagttcttctctaggacattgcttgtactcaagagcagtcacatgaatacaaatagacttagggtctcttttactctttgaactctctgacttcctacaaaaatgagagccaggcccacaaaaacaaaatcctacataatttcataccaaaatcatctgtgagaaaaggtacacacaaaacagagtagacaaaaacaatctatcccataaaggaacagcagcatattgcaactgatgtgtggaactacagaccagatcactacaacactatgtcattacagacttcatcatcttcctacgttgcttctcaactgataccaaggataagactaagcacagttaatggataaccaactcctattgtatttctcctccctggatttcccataacccaagaacaattgagaatacatacatatacatggaggggcttgctttaatgttgccagtgatgactttcacattattgtctatgtctctgtcactgtgactggtttcatcatcttcagtacatccctatggagtgataaagacacaggggaaagtcaaaattgaagtagataatttttggctgtcaaaggaggacttttgtcttaatgttaaccctagagttgatagtcttaactgatgagaataaagttgggacaaagcttagtaaacagttgtaccttatggactactgcttctctcccacatcaagatcattagtgtagataccttgataagttttgagaaaatgggccttgggtacagtgttcttataatggtagattgctcacattaatgaaagcaccagataccctgaagaagtttgacttggttctagaatattttagtggctttggttgctgactataatcctcaattggcttttattactgctcacatttattttctttctttcaaaatcccaaaaggaaatctgaatgtggcagtacacatctgcagtcccagtactgatgaggtagaggcaggactgagggctcgaagcccagtttttaatcccaccagccctcaggaggcagaggcaaccagatctctgtgagtttgagggccagcctagtctacagagtgagttgtacagtgagaccttgtttcagaaataaataaggaaagaaggaggagtggagaggattatatctgtctaggtctcattcaccttagctccccagggctagtgtcctggcttcagggtaggcaaatagcagctacttggaaagaatctttactttggaagtaaatcctcaattttcatgtattctatattagcaaatttgcaaatattttaattgccttttggtcatttcagacacgcacagagaggtgaacaatttgtcacctggtttcagctctcaaactttaagcacacatcctctacattgttcatctaatatcacaatttccacatttacattccttttgctggcaacctccaccccaaggcatagtgctaaaactctatgcggtgtgtctaagcacacaaggctgtattgatgctgtgtcttgttcaaattttaaagtgtgtgtgtgtgtgtgtgtgtgtgtgtaagagagagagaaagagggagagggacagagagagagagagagagagagagagagagattggctctcaccttctaccttctctgggacagggtaagtcttatttctgccatgctgcgtagttcaggctaactggcctacaaccttccagaccattctgtctctgcctctcacctcaccatagacattctaggatcacacattcaaggcaccacatctggcttttaaaaacactttttatgggctaaaataccttttcacagacacacactttagaaaatgatactaaaaatacacagtgcgccagaagctgaatgacacacaataaggtagaactgtcaccgctctttctgtatactgtgcttcaataattcggccaagaataaacttgctacgtgtgcagttacactttagtttattcatggtatatactaccaaggaaaattttgggggtatataattaaacacattatcagtttgtttggatttttaaaaagctcttctcgcatacataacattctgactgcatttcccctccttccagtcctcctagttctccacccccagcccagccccatgagctcccctctcccccagatttgtttggaaacttttaaagtgaggctttcgaaaatggatgcactatgggctggagagttagcagagcacttagtagttctcactgctattccagaaggcctgagcttaatttccatcacccacattgtacaactagctcacaagctctttttgtttttgttttttgtttgtttgtttctgtttttgtttttttgagacagggtttctctgtgtagccctggctgtcctggaactcactctgtagaccaggctggcctcgaactcagaaatctgcctgcctctgcctcccgagtgctgggattaaaggcatgcgccaccacacccagctgctcacaagctcttataactcctaactataggggatcttctgggaaacaattgaccatcaattaaatacaatcttagcgtgattcagttttcagtggacatcattatcattatcattatcattatcattatcattatcattatcattatcattatcctagtaccatatctattgcatcatgtttagagcttatccacccttgacatttgtgttttttcagagtcccatcttggtgtgtttctgtcttccttggaccacttacagcttggcaagtgtcctcatcatcggtactgctgactctgtcctcctgaagaatatcttgcaggtgaagaaattcggcagcgctagagaaaaatgtcataataataaatacactggagagtcatttatctcaatgacagactacatgcaattcagaaaccgacatactaatctgttgcttaaagtaaaatcaggggccaaataaatgattgaataactatgatttacttcagaaaaatgccttgaacaaaatctaaaagctgaagcgtgtcacctagagtaaccttttcattgtatagattaaagaactgaaatagtgaggtgaatctgttttttgactataactttgttgcacttctactggcttacttgatatatgtattttgttccccaaacactttccttttaaaagcttcagttttggaattttatcaagtttgttcttgttttttgtttgtttgtttggtttttggtttttcgagacagggtttctctgtatggtcttggctgtcctggaactcactttgtagaccaggctggcctcgaactcagaaatccgcctgtctctgcctcccaagtgctgggattaaaggcgtgcgccaccacgcccggtttgttttttgttcaggtcacaatcaccagcctaattttgattcccaatattcttttttttttttttttttttttttggagacagggtttctctgtatagccctggctgtcctggaactcactttgtagaccaggctggtctcgaactcagaaatctgcctgcctctgcctcctgagtgctgggattaaaggcatgcaccaccatcacccggcgattcccaatatttttaacagaaacagatttgttcctaacagtagtccctaaatgatttaactatattgcaatttgggccctggatcatccacagtggagaatgtgtgcttttcaaggcagtctagaccaagattctacaagtaggtgtggctgtgcttgtgttcctaccctctgttttcatgaaacaaataggctacattttctcctagagtttctgggagttccattatcagttctctgggacactgtgcctcattcactagtcttagcaactagaatgcttctggccttgggaacatcccccatgaaaactgagtacaaaagagaaattgatatctaccatgttcataacaagggtttcagaacactgtgggaaataaaagtccaaagaaaattttttagtcttactgcagtaacacttttttaaaaaactcacagcaacttaccagtttcaatccacaagaagactaaaggctcttttctttttttggggggggggagcgtcatagattcccggctactgctctaggatgtctcatggaagtgtacatttctgtgctgagcatcaaattgtgtggcaaggtcatgcaagatgtatttcttgttcacttgggtggaaatcagctgctgacaccaaaggtgaccattgctgatgtgaagaaagtgttgcacaacttacctcagtggctcatctgcctgatcgtcggtgtcatcatctgtgatcatgaaaaatcaaatgtgaaagtgcagctaggaagcaaagggtggtagaaaggaggggttgggatcaaaggcctcttgagcttaaactgctgggtgcaggagactgctacctgctcaatgatattgttgaagctaaatacaacagagatttttttgtttacaacctgtggaatagttagttggagattggaccctttaaacaagcaagaatataaaaagaaaaaaaaataaaagttgtcgtttactaccttttttagtgttttaaattttgtatttacacataccaaaaaaatagtattttcatttattgttttgactatttgtaagtaaacttggaaaaagatcccttcagcattatttagcactttttcaaacacattaggttcttgaaatgggtgaaggaaaatgagcttaaagggggatgcagaacaaaaaggtacctgagttcctcttcagaccgggcccactccagcactaaaggagagaacccgagctgctgagttcattcccatgaaggcttaactgttgggttttggttttggtttattttttgtttttggtttttaaagacctagactgtcaacacataaataaaaaccaaaatgacaacaacaacagaagcaaaaatatcaaggtgggggttgggggtggggttccaaggtgcaatacttgcccagagcagaggacggcccaggctggaatcccagaactgcgaaagaaacaagagagaataaaaaggcaaactgaggattaaaacatacacagactcaaatgcaaataaaacttgtgtttaatgtgttagaagtcaaagcactttgaaaatatcctcacatgtattccatgttttaggaggtataggagcaagaatatatagattttatgggctgttatggaggaagcttaaacaactttattgatattttgtttgtttggaggtagggtctcactgtatatagccctacctggcctggagttctctatgtagaacaggctagcctcagagttaaagaggtttccatacctatgccttccaaggggctagcattaaatgtatatgctaccatatctagctcactttctgtttcttgttttgttttgtttttctcaatgcagagtttctctgtgtagtcctggctctcttggaactcactctgtagaccaagatggccttgaatttagagatccacctgcctctgcctcctgagtactgagattaagggcacgcacctccactgcccggcttcccgcgtactttcttttatttttttttatatattttttattacatattttcctcaattacatttccaatgctatcccaaaagtcccccataccctcccccccccactcccctacccacccactccccctttttggccctggcgttcccgtgtactggggcatataaagtttgcctgtccaatgggcctctctttccagtgatggccgactaggccatcttttgatacatatgcagctagagtcacgagctctggggggtactggttagttcatattgttgttccacctatagggttgcagatccctttagctccttgggtactttctctagctcctctattgggagccctgaaaatgaatccaacgtatatgttaaatgtcttagtttataagttttttgttgttcttgagtaggtccttcagtttgatttaggagcaataccagataacccacattcgaggagaacgtagaaagaagatggtaactgcaggctcatactggaacattctaatctataaaagacaatcctttccaacagtctaccacctccaggtccacatggttaactaacactgatttaattcattcgcaaccgtctgtgtcattctggttgcctccagttaaagggaatctctggtttagtttgacagctttggagaaaactaaggatcctaggatgatattacttagatatcaagggagaggtggcatgagaaatgaaaaccctggggagacaggagatggtttcccctttgctcctggggaatttgaaagaaacagtgtccctggactcgtgcccagaggagtcactttcctctttccggtaactataaaaaagtaagtaggtttttacctttgaaaagccagttttcttcatcctcgaattctggcaagtccattgcactgcattctgcttcagaggtcttggggctttgcttttcagacatagctccgggattcggcttctgtggagggagaccttgttggtggagctgatacccaagtctaggtgggtgctgtgaataaaggcctgagggcttgggccagagcttcaagtttttatcacagctcgtgctggggtggggtcaagttgagggggcggagtctggagagcctcgggtattgggaatgggtagaaccagagaatgacacacctctgtagtatcctaaatgcctatcttccatggaggtcttagaaaacattgacctctacattttccttcagctagggtaaaagtattaaggaaatctctgtgatctagtgagtattggcatgaaggagtaggtcctgtgtacttctttttactgatcaggtattagatcttccaaccatggagcttgtccttcccaatctacccttccagtttccagcacttgtatagaataggagggtgggtgggatcagcaggcagtggtgtaggaaggggacagtggttgggaaccagtagatgggaggtgagacctagaggtgaggaaatgggccaggagcaggcagggagttctgcagaactgtagtataagagaatgtcattgtactttatacccctatcctctaagggcatggaaaaaaactggagtctgacttttctctctgctggggtggaaaagcttaacagtatctgagcgaaggctgggctgtaggagccattcttatacccttcctttcagtgtgtcagatactgggattcccagagcttgactttatctatcaacaggcacagactgttagttcccagcagtattcaaggagcacagatggtgggggtgggcatgaggctggaaccagcgccatgacaggtggggctcgtggcagaagctatggggttatgtggggtaagatggtgatgggcagagaggtgggacacgaactagaaagtagcacactttggtagtacctaccctaaatgtgcttcctcattagagggcttagaacaaacacactcgctgctaggttgcggctctatgggaagcagcaagaaaatgtctgatctagtttaaagccttggaggtgggctgccctatgttcttcctttggatgcattaaatattgagacctcctaccttacaaagccagcaagaactcactgcacaactggactcgattttccagtggatctgtaatgagcaccagactttcaaacagtccttgtggagtacttaaggtgggggaatgaacgacagggcatggtgcgtggtggtgcacaggtctggggggccagaaagtgaggtggtgtgctggagttggggcagttcgacgttagaagagactgtcacacctttgtggcagcaggctaaaggctcatggctgctctctgagggatgatactagagaacagcgagtggcattgttctttcttcaactaccctagaagcacaagaaatggctgtgctctagagaatgttttcttgacacaaagtctcagtatgtagttctgctggacccaaattcgttatatatatcagattgtccccaactcacagagatccactagcctgcttctggcctcccctagtactgtcattaaaggagtgcactaccacactgtcctttggttgctattttgtgcagccatttctgtgcttttccttatattgggccaggtagtggactgccttatttataaagatagaagacctcactttggagcacgactctctttttcagagaccctgtacagtcctcatttagatttcccagcagtaattatggagcccagaagataggcttagggtcatctgggagaggagtaggggaggttagtatgggggaggttgggagtctaggaagagagaaaatctgatctttgtagtatcataatgttccatccacattggaacacttagaaaatactggctcctagattctctatcatctaggatggatacacaaaacaaatatctgtgatctagttaatgttagggaggagagggactggatcttcgttgggtccggtactagcttggctatcctcccaaacctacaacacagaccactcttctccaagtgtggcgacggtggtggggaggagcacgtcaagtgtgtgtgaaggggccaggtggggggtataggactagagaatgtcaagcctctaaagtatccgaagactcacattggtcggaggaccctgaaaacactgatgtacactctccctcacctagattggaaaagctaagaaaacaggactttttggtcattgttgttggggtgtggagatttgcatctatagtccttcttccactagatcaagtactgggcatctcttctttataaagatcttaaaaccttattggggatattgattgtcttcctaaaacaaacagaactaaaccaaacagaatgaagccaaggcacctaagctaaccttgacttaccttaccatttgattttgaagtagtgcttgagaaacacgaagtgggactagggtgcagtagagggagataggagggtggagctgggggagggggagggtagcacaggggttctagtggggtaagaatagaaaaagtcacatctctgtcacatcctgaaggttcgttgtggttggagagcctagaaaatactggtgtctaagttctctttcagttaggttggaactgtgaagaaaatgtctgggacccagttaatattgaggggttgaattgtccctatgttctcccaatcactgggttttataacagacttctttatgccttctacgggtgccaagacctcacttctgaccctggctttcctttccagggacaggcccagaccgttagatttcctagcactactcatgcagcatataaggtgggctgtgaattgggctggaggtggggatgtggatcaagagggtgcaggtagggatgtatgatgagagaatgacagccttctgtagtaccctaaaggcccagtgaatattctgtcacatcaccactgaaaattgaaaactatgctggtgcctagtctccccccagctaggatgaaaagctaagaaaatgtctgtgatctagttcatggctgtctgtatatgcatacatatacgttggtggggagagatctacctgttccttgctcttcctttcactgggctatggaggtgacccatagtgcctccagttctggtattggtcttcttaagttgaaacagttaccgagatcttactgaagaggttggctcttcctcccaactgactgtacagacctttagatctcccagttgtacttgccaagcccagaaggtttgtccccttggccttctggtatacagaatttgctctttctgacagttaaaaagcaagcaagcaagcatactgagctcgcttacattaacggcttgctccccacaggcatttctttcttttttggggagagggggtgtttccagacagggtttctctgtattagccctggctgtcctggaactcactttgtagaccaggctgtcctggaactcagaaacctgcctgcctctgcctcctgagtgctgggattaaaagtgtgcgccaccatgtccggcccccacaggcatttctgcagtctgttcctaggcagccatttctgcagtccttctgggttctagtttgctttctattgataagcggcttaagaataattttagggtttctagtgtgataaaacagtatgggtggggctggagagattgctcagtggttaagagcactgactgctcttcggaaggtcctgagttcaaatcccagcaaccacatggtggctcaaaaccatctgtaatgagatctgatgccctcttctggagtgtctaaagacagctacagtgtacttacatataataatagtagtaataatgataataggagttaaaaaaaacagtatgggtaacagtgacttgggggagaaatttcatttcagcttacaattctcaagttactctcagggagggaagtcagagtaagactcaaggcaaaaatctggaggcaggaactgaagcagaagccttggaggttgcttactggttgactcccttggtttgctcagcctgctttctgatggaacccaggagcacctggccagggagtcaaggcctactataggatgggccatcttatagcaaaatgggggtggggagtcctacagacttgcctacaggcaatctaatggaggaatttggtcaggtgaggatggctttagcctgttttttttttttttttttttttttttttttggttttttggtttttcgagacagggtttctctgtatagccctggctgtcctggaactcactctgtagaccaggctggcctcgaactcagaaattcacctgcctctgcctcccgagtgctgggattaaaggcatgcgccaccacgcccggctggctttagcctgttaagttaaaaactaaaacacaggagataagggtttttatttcatccctctaagtactttcaaacttccctctgaaacctcacaaaccaggccttcatcgcctgcatttctctcagcctccctacctcccaaggtcttaatggagtggtccattaagcagtgaccactcaacagcttttctagcccaacattccacactctatcacaaccctttccaaaatgcgggcaactctgtcacagcaacgaccatactggtacaagtttctattctagtttgctttctcttgctgtggtaaaatactgaccaaaaccaacttggggaggaaagggtttcttttaccttactgggtatagtccatcatgaagggcagccagggcagaatcttaaggctggagggagcctggatgcaggaagtaaagcagagaccacagagaaatgctgcttactggcttgcctaacttgcttttttgtacaatccagaaccccttgcccagaggtgatatagctcaggggacctcctacctgtcctagaggagcaagcaccatccacaatgaactaggtcctcccacatcaattattaaataagaaaatgccccagagattggcctacaggccaatctgatgggggaattttctcaaccgaggttcccttttcttagatgaccctgctgtgtgtcgggttggctagaaactgcccagtacatgccctccctttagtctttcttgagagctgagtgccttgccccaacatggcctctcactgctgctgctcctcaggaagaaagcttcctgcccccatttccctttagtctcttgttttttatgtttctgtctttgttgaaacagggtttcactatgtagcccttgctggtcaggaacctgctatgtagattaggctggcttcagactcaaagagatccacttcctgcttctgcctcctaaatgcatggattaaagatgtgcaccactatacctggccaaggttcttgtggggaaacacaatgggcacttaccttaatccaggacagtggcaggtgtgaagtggattacggtaccattactgtcttggggtcttgattgtgttcattctccaccaattaaagaattaaaaggcaggaagaagaactcaggcacactagacaacaatatttaacacactttattaaatatatgtgaagaagggcaccatacacacactcacacacacatatgagagagacagacagaggaggtggtggtggagggaggcacacatgaagaaaagaatccctgcagggccgagaagggatttggaaagccaaattcagtttttaaaatctggggctgggaagccgggtgtggtggcacacgcctttgatcccagcacttgggagacagaggcaggcggatttctgagttcgaggcctatttttttgccatctttattactgatctatgtggcctctttgcctatctatctgcctgtcagggaactacccaatttttagtccctaagcactgaccaagccttttagagcccaaagaccacacaacaattgagtttcaaatgcaaaacctttgcctacaggatttagatctatactgctagattttggtttggtttgattgttttgttttgtttctttttttttttttaagatttatttattatatgtaagtacactgtagctgttttcagacacaccagaagagggcaccagatctcattgcggatggttgtgaaccaccatgtggttgctgggatttgaactcaggaccttcggaagagcagtcagtgttcttaactgctgagccatctttccagcccttgttttcttaaaatttatttgttttatgcatattggtgttctgtctgcatgtaagtctatgtgagggtgtcagatcccctggaactggaattacagacagttgtgagctgctacgtgggttctgggaattgaacccaggtcctttggaagaacagccagtgttcttgaccactgagcagtctctctagcccctttgctttcttttttttttttctttttctttcctttttgttttttaaagacagggtttctctgtgtagtactagctgtcctgaaactcgctttatagacctggctggccttgaattcatagatcctcctgcctctgcctcctgagtggtagtgtagattggtttcctatctggaatgagtagaagcttgttcatatctctccaggaatagtgcacacaacacaatctagtttttaaaatatatataaatcctggctgtttaaaatgcctgttttcaccagttgtgatggcacataccttcaatctctacactcaggaggcagaggcagggggatttccatgagttgaaggacagttttgtctacagtgggagttgcaggccagccagggatacagagtgaggccctgtcttggaaaataaaataaatgaataaatttaattaaaaaaatagatgcctaatttcctcatctgttgcctttattttgttaggctagacagtattcttgattattttggttttaggcatattatttttatcatatatctcatgttaagtgcagagaattaaaaagcagtcacactgggatcttaatggctagcagagtttgacattatccagaaacattaacattaaccttccttaatggctttctcaactagtcctctctctcccaaagtttaccttcctcacatctcagcctcatatatgagtcttttttttttttttttttttttcgagacagggtatctctgtatagccctggctgtcctggaactcactttgtagaccaggttgcctcgaactcagaaatctgcctgcctctgcctcctgagtgctgggattaaaggcgtgcaccaccattgcccggctatgagagtctttataacaatgatatattaatatttgccccacacatgcacaacatgtgatgctagacctataggaggaactatgaatggaagttactagaaactgcaccttccatagaaacttcttcaaggctgattaactgattagaatttcaaagattatggagaagttggaatactgttggtccatagcttaatttagttatcttaaactctatttagcctccttaaaaaagcttttctttagaaatcagattcattcattttattttatgtggtttttttgttgtttgtttgtttttgtttttttcttgagacagggtctctctgtgtagccctggctgtcctggaactcacttcgtagaccaggctggcctcgaactcagaaattcgcctgcctctgcctcccaagtgctgggattaaaggtgtgcgccaccacgcctggctattttatgtgttttgccttcatttatgtctgtgtaccatatgattgcttggtgcttgaggaggtcataagaaaacatcagatcccctggaactggctatgagccacctggtgggtgatgggaatggaaccgggctcctctgaaagtcagggctcttaaatactaagccagctcttcagcctgatattagcttccttaatagttatttcttacccatctcagttcctgatccattatcctgtgactatcagagaaaaaccatttggaatgtattaatttaacaaatcctcaatttccatgacccaaaacattaaataacatttgagacttatagctgagatttttccacttgcctgtaacctgttatctccataatgtgtttaaaaagtgtgttggtttgtgactttcttcttcctgagctgcaatcacttctacttggcttcagaataagctctgtcttaccctctttgaggtaagagtggtatttttgtgtcaacaattataacagcacaaatagacggacacaaatgggctaagggattctgatactacttcattcactacagatattgttattctaggtttgaactctgcccctttctaggcatcacttagttttcttacctagcacatcagggtattggggaaaaaaaatcagttaacctgtacaccagaattacctggccaaggtaggaaagcggggagggctaaaaacagatgcccgattactacatcatagagattctgtttggggataggtcctaaataccaaagtttattactttccccaactagatctcacaagttcaactgtatgggagtctatcagttggccctttggtgaaggcagttttaaagataaacaagtcattttcatgaagattgacaaaagaagctttggggacagattagagactaaaagaaatggtggaagtggctagggtatagcttagttggtagagtgcttgctcatttcagcccactcttacatttcataacctgggaaactaagcttacataaatcaactttgccaatactgactttgatagaatacaactgtagcaattccaactagagtggaggtaggaggatcagaattccagctatatagtgagttcaaggccagcctgggatctatgagacttgggaccagggtggaagacagccagagtccacaggcctaccctttggggactggggtaaacactactacagtgagcaagtatgtggtgaaaagatggcagagaaggagaagcagagcagtttgtgttctatgaagagaggtagaactatgaggaacagcctgatgtgagaggcttgcacagccaccatgatgatgtttgggactgtgctgccgccaaaggccatgtatgcttctgtggccctatagcagcaggcatcagtgtcaatgaccatggcccatgttaccactaaaggccacatgggagtgcacggtctcacacgccatcagaggaaatgttgctgtttgagggcagtacccagccgccgcctcgccccgccccaccccccttgcacgctgaggcacctgggagagctggccccgccccagtgtggggcagtgcaggagggctggccccgccccttgcctggccttaattgcgtgagcgggaaagctggcccctccccttgctcgctgaggaacctgggagagctggccccacccttgctcattgaggcactttggagaaggaggccccgccccttgccatggccatgagggctagtgggctgaccaactcagctaccactcaggcccagatccaaggctttaggttagcccaccccaacacataacctatctatgatctgctgaagtgcgtgcagggggtctgtctgcagaaccaaaactgcagagtctttgtgacacagggcaacagtaggatatcctagagaagtctctgtgagggtctggttttgatgatgtagcagaagtcagaggcctcgaaccagaccaatgactcattgcaataaacatttgcaagttaacatgtgtggagaagggttggagagatggctcagcggttaagagcactgactactcttccataggtcatgatttcaaatcccagcaaccacatggctcacaaccatctgtaatgagatctgatgccctcttcaggggtgtctgaagacagctacagtgtatttatatataaataaataaatcttaagaaaaaaaagatgtgtggacaaaagggtatagtgtgagacacactgtgacacactgcagattccacagcaaggtttttttttttttttaattttaaaaatatttttagggggctggagagatggctcagtggttaagagcacttgactgttcttatgaaggtcctgagttcaaatacacatggtgacttacaaccatctataatgggatctcacaccctctactggtgtgtctaaagacagctatagtgtacttagatataaataataaataaatctttaaaaatacttttagtttttttggggggaggggaggttgctagagtggagggttgatatgcagggatggtaagattagtgggattggagtgcaggatgtgaaattcacaaagaatcaaaaatggaaaaagcaggaagagggaggataaataacagggtatttttttttctttttactggttctccattttacttcctgttattcatcaagtggctcacaactttctttaccttcacaaaagctcccaatttgcaattcactttctatgtatcaccttctcccccacctccccctttgagatgagagtccaactcttgctgttctggaacgtgctgcgtataccaggctacccggaaactcacagagatttgagtttatgcctacttagtgctgggattaaagtcctgtatcatcatacccccttttaaaaaaagaaacatgtattctacttcgtatctttgtggtttagcaaccttgtataatgctagatctcaaaggcttgaaaatcaagagtagaccaggctagagataagcagcagtcagctcacctaatgatacaacatgcattttgtcatttctcatctcgggccttttgctgatcctttgcagtcctttcaagatccaggttctgtattaggaactgaaacatacccaagatctctttctactcattggtaagtcagctttgaatacacatgctatagtttcccaatttcttcttttccccgtgggggggggggtctcttgcttctatgtatttctttggctggaaaatgatagcaaatcgagtgttaccttactggatctcaatttcagtcgtgtcaatattagagcccaaaaagtctgaaacaagacagatttctttgcaaagacgttggacaagtggacacaggcaaagaagagcacagcagctaactgatcagttcaaggcccgttgataggtatttaaagtattagtggtagcaggaagaggggctctgaatcccctaactaaggaggtattgacagtggatagcagctgttggcagagggaaattcaactttaagagtgtggcccttggtagttgcagtgaacgggcaggcccacacccaggtaaatttggacagcacaaactggacttgtggtttgtctgtctgtctatctatctatctatctatctatctatctatctatctatctatctatctattaaaaagaggactcaatgttgagaaggaatgaagtggttagggattggtctgggaggagttgatagaggagtagggagtagtatgagcaaaaaacactatataaaattttcaaataattgatgaaagcatattaaaagattagtggtcatttactttatactaaaagattagtggtcctttaatttgtttttagcattggataagtgatttacctaagcttcagtctggctggagagatggcttagtgcttaagaacccttgccactcttccaaaggactggagttgtgctcccagtacccatgttgaacagctcacaactacctgaaactctagctctagagggtcgatgtcctcttctgacctctgtgggcattggactcttgcgaacatgttcatatgcacacacacaaacactcataaataaaaaataaatcttaaaaaaaattagtgggggctggtgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataaataaataaatctaaaaaaaaaaattagtggacatttagttttttttccccattggacaagttggtttacccaagccttagcaaccctggttctaaattttaccccagctcaaatgctctaagtactgtgctaagcacgtggctactttgtgactgtcagagctttggagtccagaaagtggggaggatagagagtggacagcttagagaatgaagtaagctttaagacaaagcagttaggaagctcattttccctctcaagaaggagttccttatcttcaagttagacatcagtaagcctactttactgaaaaagctcaagcttttggacagtgagaatttttgagagaaaccagaaagctgcggaaatgttaaaagccctataggtatgtaaaatgtgattgggctgaggtctaaggaactgaaaggcaaggggctgcgggcagtggtgacgcacgcctttaatcccagcacaggcaggcggatttctgagtttgaggccagcctggtctacagagtgagttccaggacagccagggctacacagagaaaccctgtcttgaaaaaaaaaaaaaacccataacaaaacaaaccaaaccaaaccaaccaaacaaacaaaaaacaaatgcatttcctcagtacgttgtgtacctacctcttaaaaattataaataaaatatcttggcagggtagcttttgtgaatacaaggactcttgtcacatgccatatctgggagccctgctcctgtttgatttgagaagtctaaatttaacctattcttttttttttttttttttttggtttttggagacggggtttctctgtgtagccctggctgtcctggcactcactttgtagaccaggctggcctcgaactcagaaatccgcctgcctctgcctccagagtgctgggattaaaggcgtgcgccaccacgcctggcttaacctattcttaatccaactgctgacatcatagcttgattaaaacctactatgctatcttaagtgctatgataatacagacaggaatttaaaacatgatttttttttcttctcatgataccataatattttagttgtggtggtaaaagaggagtgctttctcctttctgaataaaaagttgagatttgtggactgacaaatgtaccttttctggagacacttgaatagcatccccaacgtgtactataatttttaaaaaatctggataataggaaacacatttgcagaaatagcatatactgtacacaagtgctaactaggtaacaaacgaggggacaatgttactagatctttttttttaagatttatttattatatgtaagtacactgtagctgtcttcaggcactccagaagagggcatcagatttcgttacagatggttgtgagccaccatgtggttgctgggatttgaactcagaacctttgaaagagcagtcggtgctcttaatcgctgagccatttaacatggggaaccagcccaggagaaagcagtttgttgcagtcaacaaagctgaaaaaggagtggagatctgaagactgctttgacatcagccatggagatgcagagtttggagtttgcccagctggtttcctgccttgctttggggatcacagttaattaagttgaatgaatctcagaagagaccttgaactttggactttttaacattgttgcaactgctatagactatgaggactttgaaagttggactaaatacattttgcattatgctatgtttaaatatggccccatgttactagatatttctacttacaagggccacaccaattcatggacgcaagactgccagatcctcttagagaacattctactaaggacacaaatacttcatttttcaacctagttcctgagttcccagagcatcctctctatgttcatagagctctatctgcctgcacagatttgcacaccatgtgactaagatgcagggtatcatcaaggggaagcaagaagacctttctgattccattaatggtgggtgcttcaggttaacgcatgagctttgcatctagggcacttaaagaactggtaaagatgcacaatgttgccttacaatgttaaataatgtgagcttaaaaatggagacctgggaagaccattaaaaaatagtgaaactgttcacttgacagtgtagaagtggaaattcacactgcctaatacctcacagttagtaaacagaaaaacaaggcatttggatacaggataaattttgggttgaaagttttgtggatgggttatcctgtatccaaatgcaggtacaggggatggagaagagactgaggaaatgaccaatgaatatcagcccaacttgagacccatccctgacactattaatactctgttatgcttgcagacaggaagctagcatgattgtcctctgagaggctccacccagaagctgagtcaaatgaatgtagacactcacagctaaacagtggatggagcttggggactcttatggaagaataggaggaggaactgtgggtcccagaggggataggaactccattgatagaccaacagagtcaactaacctggacccaaaccatacacaggctggacctaggcctccttttcatatgtagcagatgtgcacctcagttgtcatgtgggtcctgaacaactggggcaggagctatcccaaaagctgttgcctgtctgtgggatatgttcttttagctgggctgccttgtcaggcctcagtgggagaggaagcacctagtgtcacagagacttgatatgcccagggaagtggaaggagatacccaggaggggccccaccctctcagaggagaaggggagagggagatgggggaagaattgtgggagggggttaccaggaagggggctgtgagtgggatgtaaagtgagtaaaaaaaatgtataacatgaataaaagagcttgctttaattaatttggctctgatgatctgagtcggtggcctttctcctcccacatttgggattaacagtaagattaaataaacccttaaatcaatcccagttttggtctgattccttctttcccggttttccctttttgcaacaggaatgctttgtgtcattgtgctttggcagtatgtaacttgtttttgatgttttaactgcttaggtagagctgtgtttttaggaggctttggactggac

SEQ ID NO: 4 - DNA, 19450 bp, Mus musculus
ccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatct

SEQ ID NO: 5 - DNA, 5074 bp, Mus musculus
ccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaac

SEQ ID NO: 6 - DNA, 43014 bp, Mus musculus
gtgcagcgcttgtgtcaggcgcaatctcgcaagatccggtgaggcgctacgtcgtgctccactcggtcccaaaagtacctgcaagcgctacacacttgcgctcggcgcccttgctctgttctcactttccgagatatccacgcatcttgagtcctgcatccactcccgggaggcggctgcggcaagcgcgtgatggaagaagagcgtgatagccagctagacaggtggccagagcggagcggtgggtgagatgcgggctaaggagagggcagatgcctaaagtgctgcgggacggtggagaggtgcccgaagtccttgttggggtggtggagaggtggctgaaattcttgcgggatagtggggcgatggctaagtgcttgcaggacagtggggcgatggctaagtgcttgcgggacaggggagaggtggctaagtgcttgcgggacagtgggacagtggcaaagtgctttcaggacagtggagcgatggctacgtgcttgcgggacagcggaagagatggttaaagtgattgccaagcagcagaaagattcctaaaatgcttgccagctatgcggagatgaaggtaaaatgcctgcgtagtcccgaaccgatagttaaaatgcctgccgcataacggaggaataactaaaatgtctgctgggtcctggagccaaaatttaaaatgtctgtcccttacaggtggttagactaccggtcagggacctggaaagatagcttacatacatgccacgttcccggactaatggcttaaatggatgcctgggactgggaaactttactaaaatgcctaccaccggggacctgggctatcactaaaatgcctgccaccgggtactgggaggtcactaaaatgtctgccacggggtacttgggctatcactaaaatgcctgccaccgggtatctgggctatcactaaaatgcctgccaccggggacctgggaggtcactaaaatgcctgccaccggggacctggtaggtcactaaaatgcctgccaccggggatctgggaggtcactaaaatgcctgccgtcgaggatctgggctatcactaaaatgcctgccaccggggatctgggaggtcgctaaaatgcctgccaccgcttactgggaggtcactaaaatgtctgccacgggggacttgggctatcactaaaatgcctgccaccggggacctggtaggtcactaaaatgcctgccaccggggatctgggaggtcactaaaatgcctgccgtcgaggatctgggctatcactaaaatgcctgccaccggggatctgggaggtcgctaaaatgcctgccaccgcttactgggaggtcactaaaatgtctgccacgggggacttgggctatcactaaaatgcctgccaccagggatctgggaggtcactaaaatgcctgccaccggggatctgggctatcactaaaatgtctgccactggggatctggaagatcgctaaaatgcctgccaccggggacctgggctatcactaaaatgcctgccaccggggacctgggctatcactaaaatgtctgccactggggatctggaagatcgctaaaatgcctgccaccggggacctgggctatcgctaaaatgcctgccaccggggacctgggctatcactaaaatgcctgccaccggggacctgggctatcactaaaatgtctgccactggggatctggaagatcgctaaaatgcctgccaccggggacctgggctatcgctaaaatgcctgccaccggggacctgggctatcactaaaatgcctgccgccgccagggacctggggagatcgctaaaatccctgccttataaccaacccctagaggtcgactaaaatgtctgctgggcagagcagaggtgatgaaaatgtctgggatagcgtagagatggttggctaaaatgttacaggtagatatgcaaagcgttcaataagcctggcgtgggtaataaactgcagtctagagcggaaaagaaagttaagggcgtgacttgtagcagggtctagaatccacacactcacatcagggaaagcctcgtgtccgaaaaactctttggaatagtcttaatattttaatattgctcaagccaaattcagcaatactacctcaccgcacgtgtctttttcaggtaagatttttgctcttttttttttttttttggtaacaattttcccgccatgtgattatgctaaaaaccaatgggattctacctccgctttagtggggttttctgattgtacgcgtttggattaaagttgatgaaagaatgtggggggggggcacagattcagaaaagtggaaaaattactggtagcgtgtgaagtaaccaagaacgagtaactaagtctgcgataactttctttgagaagccttggaagttgagacctaaaattttggtactgcgttccgtttatttccgaggtacataatgacccgatctctggtatcgttgaaattcgaaaataatctgagtgctttgaaaacccattaagtttctactatctgggacaaggagtattttcggggtgggggtggcgggcaaggcaaaacaattctcagtggttcgtatctgaaaaatcatattcttatttactataggcacggaaaatccctcccggtagtgtttattcagtgtgttcagacgagcaaacaatggcactaaggaatgaatccagtttagaaaggagggaaattaacaatcagctttggttttgatgcggatttggggtgaattttgtttttgttttttttttaatgccttatttctgagacaaggtctcagtaaataacctcaaactcgcaaagctctgcctgccactgccttcagtgggacagtgccgattttaaaggcttctgccgccatgtttggattaatgttcagttttcaattcggaagagaagaaagatttgcaaagtactgattttgtaatacctatgcaaattcttacctgtgttagtaggcagacaaacactgactccccagaatatactaatatactatattacattggaggaagaaactgaggtttctaatcaatcgaccttgagataaaaagattcccctagaaggtaaggtgttgtttcattgaaatggcagggataaaagattgacaaagactctacatcggctatagacatagaggaaggcaattactagctaagaaatttgaagctaaaaagggcagggaaatgaattctctagacttacagaaggaataatttcaatttaatttcaaataataatttcaatttcaactaggtgtctcacactgaacttctgacttctaaaattataaggttatagatctgtgttgctttaagccaccaagtttgttgggggcttaaacaaatacagcactgtagtgctacctgtgtctctgtatcttcgtagaggttaaggtggttatgaagacatccagaaaaggaatcatgagataggctaaggcacagagtatgtcttttatttacagtttctttgtagaacacctttacctaatgtcttaatcagctaattagcatagtaaaatacaactttgggtagttagagaacaaatagtgtgtcatagctcaagaggctagacctctctaaaatggaggttgggtctggtgttatcccttcctgtcttcctggattgtgaatggctgccttctggctgccctgcgtctggtaaagagacagacaggtttaggctccattcttaagacctcatttgatttgaaattacgtcttttatttaaaggttttatgtacatatgcagtcaaattcgaatggtttctttcttgcgcttgtgtgtgtgtgtgtgtgtgtgtgtgtgtgtgtgtgtgttcatttttgagacagcatttctctatgtaacagccctggtgtcttggaactagctctgtagaccaggctggcctcaaactcacagagatcctcctgcttctcccttcttttcttgtgctgttgaatagaaatagcctcagatctggtgaataatgagttgattactcaaaaacaaagttggaagcttgtttacatgtgctgatattggcatgcctgagcagccagacagctttttctgtgcaatgtaagtagggtcttctactgaaatccatttggaattatatatactctataggtctactttattattattttagattttacgtgtatgagtgttctgcttgtttgcatgtttgtgaatcatgtgtatgcctgttgggcaccaatgtcagaagagggtttgctaggatccctggaactggagttatagatggttatgagccacaatgtgggtgttggaaatcaaaccaggtcctctgtgagaacagaaagtgctcacattaaaaaatagtagttatagctgggcaggtggctcacacttgttagcactttaaaggcagaggcagaaagggattgcagctagttcaagactagcttgggctacacagtcagttcctgaccaacttggctagaaaacacatgtttttgttttgttttgttttgttttgtttttaagtaaacatctgagcttactatttaaacacacacacacatgagggcatagccgcattcaattcatagcaaataataaaacttttatcaataaaaacttatcaggtccttgtataatgaaaatgaaagttgacgaataaacatgaaagcccaagaaattagaataaggctggaagtgaaagtccaaggtaaatggaattataggggaaagtgatggtttgaatgttgatggtaattgaggagactacacatagaaaacatttaaggcaggcattggcataagtgaggatttgattgggaagactaactcactttagacaaatgggtggatggtgtctttatcagagtgctatgttcaaacatacccttaaattgacttttcatcctcaagatttcttatgccaggaattccttttagtgttggattttactaccagtggtaaaaatatgaaagtgggttttgtttttgttttgtttcgttttgtttcacacacacacacatacacacacacacacacacacacacacacacacacacaattgtttttttgttttgttttgtttttttggtttttcaagacagggtttctctgtgtagtcctggctgtcctggaactcactctgtagatcaggctggacttgaactcagaaatccgcctgcctctgcctcctgagtgctgggattaaaggcatgcgcatgcggcaccacaccctgctcacaattgtttttaaatatgtgtgtctgaggcattggccccctggagatggagtgacagaggcttgtgagctacctgacttaggtgcttgctagcaaactcaggtcctctcagcaagagcaacatgtgctgctaactgctgagctcttcttccacctttgttcttttgagacgcagtctcatgcagtacagctggctttgagtttgctccgtagccaacgctgaccttgcccttcctgcctccaccttccaagtgttgggttttccctatatttaatatttatttattccttggcaatttcatacatgcattcactcgtacttctcccccactccctacacatcccgaagctgtcttcctataaccttaatgaggtctccttttaaaataataataataatataataataataacaaccctgtgagtccagttagcagtgcttgctggaatgttggctaatcttgtcggaatcgtatgcaggtagccacagccgcagtacgcttgtgagggcggcagccagcattttcacagcttgcctccccatctttagctctcatgttctttccagccctgcttccacgatgttccatgggccttgggcagtgtgtgggttgctatagacaccttgtttggagctaagcatgcaattgttgctcagtctcaggccagctctgagtctgcattagctgctcctccttgcagaagaaacttctctggccaaggtcgaggagagtacagtattgatttgttcttgagatagagttttccagggtagccctggctggctcactatatagtatagcccaggctggtctcaaactcacagtgatcgacctgcctctgcttgccaagtgctgggattaaaagcacgtccctctctgcctggctcgacttattttttgacatggggactcactgcctggtgtccccctcctcctatagcctcaaaatggctgagcaagagtcaggtaacttgcttctctgccattcctgaagccctgtgttccatccggaacctgcataaaccaggtgaggggtgtgcttgtagtcacagcactgaggtcaaggcagaagtgtcagaaattcaaggtcatcctatctacaaagagaatttgagaccagcctgggctacaagaccctgtctcaaaacgtacaaacaagcaaacaaacaaaaaacaaattcaggagctgagagacggctcagtagttaagagcactgactgtacttctaaaggtcctgagttcaattcccagcaaccacatggtggcttacaaccgtctgtaatgggatctggtgccctcttctggtatatctgaagacagcaacagtgtactaatataaataaaataaataaacctttaaaaaaacaaaaaacaaattcaggggctccagaagagtagcaaatgttcttggtaaccactgagccatctttccagctctcctgtccttctttctttccttccttcctttctttttcttctcctctcccctcctctcctctcccctcccctcctcccctcccccctcctcctcctcctcctcctcttcttcttcctctctctctctctctctctctctctctctctctctctcctctttctttctttttttttttgagacagagtctcatgacattgcccaggatagacccaattcttcatcttcttgctctaaatctcccaagtgccgcggttacaggcccttgcctccaacaccagctggttcctaggttctagatagctattccaagtaggtagatgcgagggatatccaattatagtttgcttcatttccctagtgggaatagagaataaggccttgtttatttacttacttttaaaggctctcatgtagcccagcccagccttgaattctgatccatggtccaccacctccaggcttgcaatgcctactggcttttttcagacctgtagtcttttgttgttcggtgtgtatgtatgtatttatttagtgcattggtgttttgcctgaatgtaagtctgtatgagggtgtcagataccctggaactggacttacagacagttgtgagctgccatgtgggtgctgggaattgaaccacaaccacggtccggtccggaagagcagccagcattcttaaccaatgagccatttctccagcccctttgtttgtttgttttttagggaccagtaaattaattttaaacctagaaagccctcccttgtctacagaattcttttagttattctttctattggaactgagcttagggtgagtgcttggttagggtgagtgtttggttagagtgagtgcttggttagggtgcatgcttggttagggtgagtgtttggttagagtgagtgcttggttagggtgcatgctcggttagggtgagtgcttggttagggtgagtgcttggttagggtgagtgcttggttagggtgtgtgcttggttacagtgtgtgcttggttagggtgcatgcttggttagggtgagtgcttggttagggtgcatgcttagttagggtgagtgcttggttagggtgagtgcttggttagggtgagtgcttggttagggtgtgtgcttggttacagtgtgtgcttggttagggtgcatgcttggttagggtgagtgcttggttagggtgcatgcttagttagggtgagtgcttggttagggtgagtccttggttagggtgagtgcttggttagggtgagtccttggttagggtgagtgcttggttagggtgagtgcttggttagggtgtgtgcttggttagggtgtgtgcttggttagggtgtgtgcttggttagggtgagtgcttggttagggtgagtgcttggttagggtgcgtgcttggttagggtgcatgcttggttagggtgagtgcttgattagggtgagtgctgggttagggtgagtgcttggttagggtgagtgctcggttagggtgtgtgctcggttagggtgagtgctgggttagggtgagtgcttggttagggtgagtgcttggttacagtttgtgcttggttagggtgagtgcttggttacagtttgtgcttggttagggtgtgtgcttggttagggtgtgtgcttggttagggtgcatgcttggttagggtgagtgcttggttagggtgcatgcttagttagggtgagtgcttggttagggtgagtgcttggttagggtgagtgcttggttagggtgagtgcttggttagggtgagtgcttggttagggtgagtgcttggttagggtgagtgcttggttagggtgcatgcttggttagggtgagtgcttggttagggtgagtgcttgggtttccagcagtatgccagagacttccaagccagccaggactgcaatgtgagaccctgactcaaaaatgaaagaaaaacaaaagcaaaacaattgtctctgtgtgtgcttagtttaatcttatccactccaccttctctccctgataggagacaaatttggttcgagtaaagcacagaggaactaattaacctgagattacttgcagaatagcccttcctgacccttgaaggcgccatgttattacacgttgctgtctcttctatctacagctctatttcttcctcttctttattcttgtgccagcttcacctcactgtgccattgtgccgggagggcagttttaatggccacttgcctgccctctcctgaccttgcgcaaggacctgggttgaggggagggctttgggtgccgtgggctcctcgtgttcccaggccctgctgggcccaggtgcaacatggtggcttcccgccccggaatgggaggagtggactctgcctctgtcattctccagtcgggggaagtgctggctcaggctctgcaaccacagtgcagatgggagaggggccatgggacagaaaggcaaggaccctcagtgctagcagctgctggctttgtgacccatacccagcccagctcctgcctccctcttggatggcagggacagtctgggaacttctacctgatcctcacatctattctctctttccagaagcctcagaaggagtctccctgcccctgagtttccaaagctcctcacccagggggaataaggatgcccatgcatagcaagaacctgtcacttgcaggttgcctggaagacccgggcagctcacaactcatgccttggaccttaactgcctgtttctagttgaggaacccaggctgaggaaaccaagttatatcaccaagagcatttattctagcaaaccatgaaggggctcatgtgtgcctcttcaatacctatgaaaaatttataataaaaaatcctatttaaagccgggcgtggtggcgcacgcctttaatccccagcactccggaggcagaggcagacggatttctgagttcgaggccctggctgtccctctaccactgagccacatccttacttagcccagatcccgcctttgaagaatcgcagtgtttggcttctaaatgaccagggtgacagtcagacgagggagtccagtgctgctgacccgtgcagcgaccctagccatcagggcaaggatgctggcagccctcctcttgactctttttcgttcgttccttccttccttcttttgtgtgatgcgtattgtatatgaatgtggatggtgtgtgtacacgtttgtgggtgagggttgcacagagcataatggagtcagaggacaacttcaggtgtgcatctggccttccacgttgtttatgagagcatctctctctctctctctctctctttcttcctttctattttttaaaacattttgttttacataagtacactgttgctgacttcagacgcaccagaagagggcatcagatcccattacaggtggttgtgagccaccatatggttgctgggatttgaactcaggacctctggaagagcatccagtgctcttaacctgagccatcatctctccagctcagacaggtcttttgttttgtttttgttttttcgagacagggtttctctgtgtagccctggctgtcctggaactcactctgtagaccaggctggcctcgaactcagaaatccgcctgcctctgcctctggagtgctgggattaaaggcgtgcgccaccacgcccggctttaaatagggttttttattagaaatttttcataggtatatagaatgcattctgcttactcttccactttcaatttccctcccgccctggccagcaccccttattccttacaaaatgtctctgtcatatttgctagttttattttgtttagtgtttcatagttcaccccagacatagtttgggaactattaaatactcatcagtggatacgtttgagtgccctgtgtcccaatcctttagttgccagtaataaatggtaaggtttcatgggcttcttggagttgggccaatgctattttccaaagatgttaagatttaccataatagattcttgtacctgcctcactcacactcgcttgcagtacctgtctatctttctcttcttgccaatcacattgtagatgaggcttttgtggttttgttggctcctagtattagcataaggtgaactgatttcaggtaaaatgttgtggcttttctggcccattcattggatggaaacgaaggcccggttttgtgggagcacttctactggttagcaatggctaggcagagccatgtctaacagtacaaactctctcctgagagaattaatctttcctcctagacgcaattttgtcactttgaattttagaactatcagaggcccctttctctattcaaggacttcttgacagccatgttctttcttttcatttcatcttaccagtactcccacttttgagcctcaatattttgcttctcgtgatcttattagatttgtgttctcataatctttctcctgaacaacttaggctctaagttatgagacctcaaattacccaaggaactggctaggcctgcctggtggtgtaggcctttaatccgagcactcctgagtcagtagcagacagtgctctatggatttagggccagcctaatctacatggacttcaggctagccagatggccagggcaacataaccaatttcattacatagggaattaaaactgaggtatctggtatgataaaagggccactgagttagaaactatcatctgaaaagcaggcttagtggtacaagcctgtaattctaacacaggaggatcaggagctcagagtcattccggctacttagggacttggaggctagcctagttctggctccatgcaaaggaaaaggggaatgtggcagtggttaagataccataatagattcttgtacctgcctcactcacactcgcttgcagtacctgtctatctttctcttcttgccaatcacattgtagatgaggcttttgtggttttgttggctccttgtattagcataaggtgaactgatttaagagcactaactgctcttccaggggatctgaattacattccggctacacacaagatggcgtctgtaacttggtttccttgggatccgacaccctctgctggcctacacgggtataacacccaaacctaatgcatagacaaaactcatgcacattaaataaaatttaaggaaaatatcatatacagcacatgatgttttcaaaacaaagcattttatttaacagcaaactaccccacccactcaaccacccacccacccacccacccacccatccacccacccacacacggactcattgtgacatgttggtaagcaacagttttttttttcaagtcttcaaaacacccaagagtcaacagaagttctgtattccgcatccgttcacaaagtccaggtgttttccatgtgttttttcacagttggtgggaagatgactccagtctttcaacaacagattggtacacagttcatttatgtgatcaaagcagatgatggtaggatgtgcttaattggtagcaatattgatggcagtaactgtgaaaggaaggctttcagttattttttcctttgcaaattccagaaatgtaagcccattcctacccatacaaagggatattactgaatccagccaatttccactaattaaaagctaatattagtaacacttttgatgcccaattgagtttaatgaaaatgaaaaaaatttgtttgaactcccagacctcttcaacctggctccatcttctctgttccttttcttttgcctgaatgtcctgattgggttactaagtaaagtctagatactttgaaagtatgcgtatgctacaatgaataagcttccttacagcaaattgtgacttcagctctaaggcaacttggataaagagatcacattgacttaatctgtttcattcccatttgactcaaggcttagctgatagccatttagatgaaaatacattttcagaaacatttagcgaattaataccaattttgtggaactgcattaaagtcccaacttagattccagatagacaggctggaccctttccttcactcggcctcctgtcccaccctctgtgagtgaaagaaaaatggaaagggtcaaagcacaggcatttttaatctttttcaagttctttcaatttggtctttcgttcctccagttttctgattgttgtcaattttattattcttaaattttatgcaagaatgttaaacattaatgttattttcatccactggcattattttaccatagcaagccaccttgagtatattatagtaaggagaacatttctaaattactgtgagcattagcatgtaaaaaggtaaaaggtttaacgacacaggcaaaattggtcaatgtatttcaaagcctgctgcagctcaaaaatggcttgtttgccccaggataatgcaaagtagcctaagattgtgaacttagatggctgtcatccctcctgaccagtagtggtcacagtcatagctaaaatggcctagaaaattgagtttcttagcgtggagggcttctgtaactttagggtcaggcttgctacaaagcccagcttcccactcattgcagtggccggagaagacatgaggatgaggactcacattgcatattacttggggactaaggactaagtcgtgccactacccagaaaagagacccccccccccatccagcacttccctatgtctatgtttcctttttccatgtctcaggagccaagtgaaggcctaagagacatgcaaatccttgtagaacaggcgaaccaataaagcaaatgaatgaataataaccttcctgtattcaacctctgaggcaaactgtgggaaatgaggaaagtgttcttcagtctagaaaacgtttgagctaatatttctgtttaataaagagcatccctctgctttccggggcatctgtaagtcacactgagtgcccttttggaacaaatgtgttgcacttagcatccagtagcatcttctgcaatgtgtggaaccgaggaaatagagaacctcttttattatttccactctaccaagcatgcccatgaggaggggagcaactttttatttaacttgcctcctctacaccttgatgtttttcccagctaaagtgagagctgtagtctcaaggtgtgactgcagtcccctcagaaactactgaggtaaagtacactttgggttgcatcctttaaatgtctttgttcttttcagtacttagaaattttagtacttagaactgcactttcatcacacttaagttaaaagtatgagtgtgatagtatattcttcttgctcacatgacgctgagccaggcaatgaacaaatacgttagaattatcgattcatcttgattctcctttgaaacacttcaacagtaagaaaaggaaaatgggtaatgaattaaaggacagactttaagtctgtcctggcttcaagctaggccaatgagaaaatgacttttggagcttccttagctaggaagtctccagtttatgttgaaggaatcttggccttggttgggtttcgcaaacagccattatagttaaaatatttactcagaaggctggagagatgactcagtggttaagagtctgactgctcttccgaaggtcctgagttcaaatcccaacaaccacatgggggctcacaaccatctgtaatgtgatgtggtgccctcttctggtgtgtctgaagacagcaacagcgtactcatatacataaaatatataattctttaaaaatattattcactcagtaatcagatatattcttcaggctgggcatgggttaagcacatctgtaatctcagcacttgagaagctgtgacagtcaccaattagaaccagcctgggctttatgagaccatgtctcctatgatcagtgatctacactaggtccacctcacattttagttttaggacctaggttagcatatttatatacaatgtttcattaggtgttgtgttctgcatgcttggtccctccagccagtacatctagttcgagaggttctgggccacactgagtacatgccatcagatgctctggcctcttcccgttttgttccctgatacccatgctctgggattatctcactctggccctataaaactcctttactggcaaggtgtttgtaattcatctctggcagcagcattcaacaaacatttaggaactggatgggaaaaagttcctgtcattaataaaaccttttccacctcctcagtcaagccagctgggaagtatcctagacagcatagtccactcagtgtaacatttagcacactgccttgcacaaatccattttttttttctgttttcatttcctcattgaagtgaattgaagttttggtctagatttcactcctataagtgctacataatgctagaaagcaatctatgtgttcgctcaacacatagcatggtaaaattattattaggtggtgttaggtgataagcattatgattaagtttcagccattatgaaacttagaaagtaatcactgttcactgataaagccaacagttaggtcccggctttatagaactgtagacttcacaaagctccacacagatctgttgtgcatgcctgggataaaagcaaagtcattgcacaccaggcaaatattgcatatatacacatatatatggcagtttacaaattataaattaatctcatgcataatttctttagatacacaggacaatgagaatgctctttgcatcccagtgcctagcaagggcactgttttgtaataaatgactgccattcagtatgtactcatcaagtattgaatgcttcatatattcagtggttcacagttacttatttactttattttcacagtataataaatgtggcagaattttaaaagcctggaaattgataccaagtaagaaaatgaattgttatatttatatggtacctccgagtgcataaaatgccaacgtacatattattctcaagtgtggacacactgaaatgtacgtctgtgtatctctccagtacccatgaaagagaatatacacatgggagacaatatttagcctccaggtttgagatggaccttatggtcttcccaggctagcctccaatttctggggtcaagtggtcctgttgcttaagctgagagcacatgctaacacacccaggttgttaactgtactcttcccattatgggctaaaaagtacgatgaaaattttgtagagactatgcctattttataggcagctttatttctatagaaaatttgtcttgtcttatactactgaactgctttatagttgagaagatacccacaaccataatgtgacctgggcaaatgttcttgtcttaacatgcccttatcactcaagttttgactgattaaattaagcattggctcattcattatgaatagtatggaatgcaaacattcttatttcatggcagttactcatgaatatttcatgtacccaaaacaatatcggatacatcagaggtagttagtagtcattcatttgcacacatggaacaattgatagctgtataatgctttatttaatgcattcttttgtaaattctagttctgtggtaatgtccccctttgttattcccagtgctgaacatgggtattcagaaattagaaggtgatcagaatagggtaatcaatcacctgcattagtgacctagtttgtagtttaaaatcagtttccatgtgttttctcttctgctacctggtataatataacttactgagcctcaccaaagcagaagaaacacactggccttaagtatatggactgttattcattcaagccccgttatgttcatatatttgtttttacaaagcatgttattcctagagcaatctttgtgcctatagcacacagaggcgtagactttagctactatgtaatacatactcagcactgacttggaagttacagtaggcttcatggtttacgtattcatacgtttcctggttacctggtaatatcttgttacctgggggtgaccacagtgaagcatcacagccttagtattcagcacaaaaaatatgcagggaaggaaattaatgttactcagacattccctggcattcatatcagggcttgatcaagtccaggcaatagaccagtgtgcctttttcttaccttttgaaaaggatttgcaactaaggaatatgcaactaagaccatgaacccacaaagcttcaggtacttagtctgatgccttataggaaaagctctacactttcagataataaccatgtataattgccaatgtgctatgagcatgtaactttttcatcctgtgtcatttaacttccctcttacagaggaagaggaaggcacgaaaaagattaagcccgttaagtagtccttagagtctctcatcattaattttaaaggtaggtattagacccaggagttcctttggtgaaatgcaccaaattactcggccactactatgagcagggagttcagacctcattttgtccccaaaccattattagaaaaccataccctgctcacctaagcccaaagaaagaaggtgacactggctggtgcttctcagagggttggcacatctgcatattgcttgtctaattcttctcattggtctggaacaactctttatattttctctagatagcctgacattgttttccccctaacaacctgatgctttccttttcttgtcagcctagggcttctgaggtagggaggatggcagtatgcatatctgtatgcatgcttattcctagggaagtttcaatagtcaggctatatacactggctggatttagttccgtctcaagtggagcagatgtgaagagaaatggaagttgtaaaacatcaacaatttaacaaatggctaagacccagtttaaaacagacccttgcacaatactatccagctaaaaacgtattcctttatgggcaatggcaacaatgaaaaattacatctcaagtgaagacagcttaaatagaaatataagaaatggaaagggatgctggggttggggggcaggtctcatcttcgaatttcccttcttggtcttggggatagaaggatagaaatatccttccagagttctgggccataggcctttatctcttaaatattctgtccatataggattgggtccttaggtcttatgcttggacttagctcaggttttgtgtcttatgacatacgtagttccccgctcttggaagtcacaggtgtcctgtagaaacagttcctcttctttgggttgtcagcattcgttccagccagctcaagacgggccatctgtgtattttggtccttttaaatctcaagtcgcaaaacttctgtcttctacttgggcgttcacttcagagccacttgaatcctgaccggacggaatgatgtattttgtcttagattatttctcagggcagtctggtgtgaggaacggctccacgggtgacattctggacctattgggaaggggctatgaagctcctctcacacatgacacacataacacacatgcacacacgcacatgtacatacaaagaaacatccaagaaaggattactttagaatacaagagagacacagacttgtaaagagatgaaatgctcaaagtgaacagaaaggaggaaagtagaagatagaaacacaagcaaacacaaagcaacagaatgatgctgagataagaaatccaccaatagcaaagagacacaaaatcaaaagaaaacagagaaagtggcccaagaaaggcagggaagaaatgtaaacaagaattcactaaggatagaagcagcagaaagaaaactgaaatggactgacaaagagaacttgaacaaagaacaagtggggtgagcacaagaaaaagagagggatgcatgcaacatgtgacccaaagggagtcacgaaaggcaggagtgaaagaaaagctaagagaaatagcaaccagatagataaaacagagagccatagctagtgaagacaaagcagaccacacaggcaccagagaaagtgaaacaaagctcaaagctctgcaagaaagaacatgcaggagaaacatgggaataggtaagacacactgcagacagaaaagacacacaaaggaaagaaggagacatgcaaaggaaggaagaaatagatgtaacaaagaattagacacacaaggaagaagtagatacacaaaacaaggaagacatagacacacaaagcaaggaagacatagacacacaaagcaaggaagaaatagacacacaaagcaaggaagaaatagatgcaacaacgaattagacaacacaaggagacatagacacacaaagcaatgaagaaatatatataccaaagaattagacacaatgcaaggaagaaatagacacacaaaagcaaggaagaaatagatgtaacaaagaattagacacaactgcaaggaagaaatagacacacaaaagcaagaaagaaagacacacaaaagcaaggaagaaatagatgtaacaaagaattagacacaactgcaaggaagaaatagacacaaagcaaggaagacagacacacaaagcaaggaagaaatagatataacaaagaattagacacaatgcaaggaagaaatagacacacaaagcaaggaagaaatagatgtaacaaagaattagacacaactgcaaggaagaaatagacacaaagcaaggaagaaatagatataacaaagaattagacataatgcaaggaagaaatagacacacaaagcaaggaagaaatagacacacaaagcaaggaagaaatagatgtaacaaagaattagacacacagaccaaggaaaaaatagatacataaaacaagaaatagacacacccacaatacacactcattctattgcttttaagatgctgcagtcaggcatgttgatcctcgggtcatttataaagctgccttccttttgtgtgttcacattgcttgatcacgctgaagacccagttttctgtgctgctttggggaagggtaatatttggtagatggcactacaaagaacaaaagaagctgtatgaatgccaggaaagaagtactagaacatcctggctctttaaattctgcctaatgatagatacttctgtatcaattccagccaggtttccatttgtagttagaggcattcatcatcagtaatgttagtgatggctcagtggttaagagcacctattgctcttccagaggtcctgagttcaatccccagcaaccacatggtggcgcacaaccatctgtaatgagatctggtgctctcttctggtgtgtctgaggacagcaacagtgtactcgtaaatagctaggtaggtaaataagctactcacttgtgtattatatggcatgagtagggtagcagtgcatcttgaagtatgtaaacagctggcaaagctttcctagcttctggagagagaaccaaatagagcagaatggcttcctcgaaggtcagtgccactattgcagcagcttttctcctagaagaaacatttgcactgtttagttacatttcccagatgtgggaaaaagataaaatttatgtatatatctcaagtaaaaggctgactttaatggaaaacaagatcaaagttaaaattattacactgttgcagaaaacttacctactttgatgtagggtggcattctttgagcctttgtcttccttgctgggttcaggaaagcgtctcactgaaatctgggctaggcctgttgcccagtggtggtgagctattcccctggaggatcctcatgccccatctccacctagggatcgtcaaagggaataggtcgccagcactgcaaagcagcaagcccacaattctggggggagatctggaaaagaggtgaaagaaaagccaattcttgaaatcaagaatactgggaaagttgtctcattatgtagtaaccagcagttgtgttaaatcatggggaggggcttggagagtgaacccttcacatttgtagatcttagtgttaacttagagacatgagaattgctccatccaagttctttctggcttttattctgtcacctaccaatgagagatcctttagattataggttgtgttaaagtccttgtacttcaaatactctgggaataaaggggttaaattattttcttcttttaatttgtgctttaaacaataccatgccagaacactggcaaggtgaatagcattgtttggctcagtgcttatggtgcatatgtccctagaaactggtgtagcattggacctctgagtttgaggatattcagagaccagaattatgacaggcctacagaatgtgacaacagccatatctacttactctatcaagtacaaaagactagggtgtcagaaactggccttcattcctctgataacctaccttttaggcatttcagagcagaaatgttacagattggtcataacatggtggggatgatttcaaggcctcatcataaggcaaggatctcattggctaactgactatgccaggggaccaggagatggggagtgctttattgacttgccccctcattctctgatgaactggagatcagatagaaacccccaaatagcaaattctccaaagtacctttttttctccatgtggcctgtaagctttttgttcagagtagcgaggacttgaagagaagttctgctgagatgtaatgtagctgtataggctgctggcagtccttgagtctcacatagggattgtttgtccctgtgaagaaatacaaggctatcattagactacaaaaattgttgaaaattccacatgaaaataatgaggtatttacttaggaggtataacttgacacattagacctttaagggaagatactatctcagtcaaccaagtaacggaaatacctttgggctctctccagcactcttcactcctctaaatccaggcaatccttcttcttgaggcaggagcacaaaacagactccaaattcatccctggaaaacaaatgataattatactaaactctacaaatgataatttgattactagcaatacaatcttcatatgcacatgtcagcgttttcaattggtggtaagaactcagggtgaggatatgttctcatggaacccctagttcttaagagatgtgaaaacagcctttaaaattgaaagcatgtctacatttcaaaggcctttcatttcttttccctttttgtatatttgagtactctatctgcatgtatgcctgtgtgccagaagagggagtcagacgtcattacagatggttgtgagccaccatgtggttgctgggaattgtactcaggacctctggaagactaacagaaccatctctccagctctcgtcttaagtgagctttctcttttcctgttttatttaaaattaacaaaactttcttatgactacacaaatagagccatcttcccctgggatgagccagaggactaagtaaggggcaggcagaagaggttcactggactgggagagagggcacaggttggacagtggctaggttatatggcagtatgcatacaaagacctggtctggttctgccacagggctttgtaaaatcagctggcaaaatccactacttccacttcccaccacttaatgaaggtgtacattctcaaattcacttgttctacagggttctttgtttacaaactcctaagtctgggtcaagccattggacagcttggaagaaagctcattcttctttttttttcaagacagggtttctctgtgtagccctggctgtcctggaactcactctgtagaccaggctggcctcgaactcagagatccgcctgcctctgcctcccaagtgctgggattaaaggctcgagctaccactgcccggctgaaagctcattcttaatgtatacagttcaggcagcctgaagatggtgatggcgagttggtggctttccattacatgattactgacagtgagggctgggtcaggacactaatttggggaactctttgtattccatcaattatggggaccaaagatggcctccagatggttttgtgtgatggcacctcctaatggacatttcaatcacagacaagctcatgttccagatgtcctactacaaataagtgtgtattttacagtgccgtggaggtcatgtaggactaggttgccatgacagaattggccctgattaatgatctgcctgctcacacaacttgatcatttcaatagggaactgtcagtgatagtgggtttactgtgaatagcagcagtaccagcttcctccaggccactaactggagtctgagtcctaatctctatttaggtccataggaggcaggctgaaagctctaggtgcctaggcaagcctggggggggggtcactttgcatgtactggggtgggtagccaatggtgctaaggtgagaccgaagctttagctaactgtcttagtgcaccaaacacattctttagcatctcaaaaagctttttttccttgcaaatgtttccttttgaagcagttacttgtacaacaatggtcctagtttcctaaaagactcaatagttctagatgtattatcacctagagagccagacaatgctaagcctttggagttgggggaaacctgctgcgaaggaatttacagtggacttaaaagggttaaagtactagagggtcatttgcacgtacaaaaggcaaatgcaaaaaaatgttaagtgttatggacaaggatgttttttcagctagaccattttctacacaggagtcaagtatttgttgttttaactgaaagtatctgttgaaaagtgctggcaggggtccagtgtggcacccacccttaatcccaacactctaaactggaggcagaggcgggcggatctctgcgggcggatctcttgagtttgagttccaggatagccagactacacagagaatccctgtcacaaaacaaaacagagaacaaaacaaaattaattgattaattaatgaaaaagaaaaatgagcaaggagggtacataaagtagtccatagtaaaatttgttcataaaacttatccttctttgcacttttgtaaaaaaaaaaaaaaaaaaaaaaaaaaaaaaagattgtaagctatgaagttctctgtctaagctgttagtgccgtccagtggtctgttctgggcagaaatgcagtaaaaatggttgaaagaaccaaattatcaaatttatattcccaattcctacacaagctcatctcttgctacccttggcgtacagctaagcataatgcatggagtctttcactcttaatattctttccatgcttccaagaggtagatagaaacagatggcattcagataaaccaaccagatggtactaatagtcgtctggaccaacaaggcaaagtaagcacacttccctctttaagaagtcaaatttcaaccccagtagacttcctaaaatacttaaacaattcacacaggcagtacatttcctaaaatgatctcaagtgtgcttatattacattaagtcttaaataacataatcatctcacggaagaaattttgtaaaatatcatcgcttctcattttagtgtaccccagcataatggcgattgggtacacaatgtgttaattctacaatttcgttggcatactatgtgttgtgtatggataagctgagaagagctagtgacttattagtcactttgacttttcagtgggtggcacagaaagaaactcgaatgagaaaaagatagcttagtagctaacaaggtagtacttactgtagtctaaacagccagagtctgatgtaacggaggagcagtagttcaagcaggatcctgcactgggatgagttacttgaacatcctcctcagaaaaatagtatcatttctcagtaatgctgggagaactgctgttgtgatgattattttcatcagcaatgtcatatcaaacactcagcagcgggatggcaagatggcacgcggagggtaaaggcacttgctgccaagcctgatgatctcactttgatctccaggacccacaagatagacgaaccagctcccattgttgtctgagcaccatgtgaatgaatgactgcgcgcagcaacatgcatgtacacacacacatacatacactcatacacaatagctcccaaaaaagacctaagtactcggcggctacaaagcacccttcacactagagaaagctcttttcttactaggaaaatctctctttgaagtgtacgtttaaaggaatgattagatcctggcagacatattttaaaatgtaaagtggggaaacaggttctatcatctctaaaataaattcccactttaggaattttcaagctacttcaaattattgccagagtttaatggtggatagaatgaattaattaaatgtgatggcctatataattttcaaaggcgacttgacatgttctcaaatttaatccatccagtcaccttttaaaaataagcaaggactggtgaccaatgtcagacaaaatataatgattagaaggcttaggtcatcttccaaaaagttaatcatactaaaggccacacaaagattgactttttcgttttgttaaacttgtagtaaagaccaagcaaagatacttgtcttaaacattctgcaatagttgcactgatctttccacagactcatcaccctcagtacactgagacactgcttagtcttcagaaacatgacacaaatggctatttttacttcacaaaagctaatgatctcacagtcaatccaccttgcaatccaaatgcctttcttaaggaataaaattatcaataacttttctggcagttggtcctgtacagtagcaatatacaaaatcgggcttaaagtttcttaagcagacagttggctccttcctggaggaagaatggaaagaaaagtgctaagcttccttctcaggaagacaattttcagttcatactgtaaaggaaagccccaagtaaaaggtggcaatccaactccctgagctacttgcctgcaatattttgcacaataaagcattaataaaggtaggcaagaatggttcctggccctagaatgtgccagcagttggaattggaataatttagaagtgcaagttaaagattgaaggctcatccacctagttttggcctgcttttgctattcagtgtataaatacaccaaaatttattaatgacacatagggtgtttggggtaattaacattacccagaataatgtaagaattcgaggtgtctctgttcagtgggagcaaggagaaggcaactgagacactgtagccatatgaagtgagtaaactggtgttgttgactttaagtcaagagaagggctttgcccagtcaatactgttcaaacaaagaggcaaaagggatggcatgatggaattgagaaagggcacaaactcttccttaatgatgggtttgtgagaattagtgattcagaaaagtggtcaatggacaaactagtggccgggcaaaaggaacactataaagtgtgagattgtgactatttaggattgtatatattaaagcaatgcaaaaagggtcgaaatccgggtcattgttgggtgtacatactgctgtactttattatatcattgggaaactagcaggggatttgctcaagttggagtagaaaataaaccatccagaactgccattgtgcctattaagagtcccaaaatcagtttaaggaagagagcaggtcattcgtcagagcccctgtgctcattgacagtaccgggtagtttcgggggctcagcaacctctgcaataatgtaaaggggacaaatattccagacattcatagttataaatacgctaacttagcaattaattctgggactcagtagccttgatggtatgcaaagagagcacacaggtccttgacatttttgcatagtaatcatccaaatgctgaggttactaatagttactaccactcagcagccccagtcaaaaggtaggcatttcagaacctttgctgccgcacaggtcatatgtgtaagggtacagattaatattgacaagagaagtgctcagaaataattaatatgcctctggtgtcaaaagagtacaaggatgtaaaatccaactccaaaggtaatgatggacaactaactgcattaatgcacttaagtccaaatgaagagcacttcgtacaaccctctttctgctttaaagcggagaagagggtacagtagttcttagagaagtgcttagacatgtgaactttccaaatgaaagtcttgagcttattatcacttcctgctgaaggtgctaaggaagtgagtgggatcctttcaagtgcacagagcaggtggcagtgcatacgcatacatttaatatatgataacagtccaaaagaatgcggccttgttgatcagcatatcctgatatagtgcaaatgaaaggcgaaggagtatggcctttgtttactggcaaagacaaaggaagattcactgtatattaatggtccactagcagggaccttgggagataaacggtatcccttgcaggagtgcaagagatacaatggtccgaaaagtaataaggttgtggataagtgtaattttacacattaactggccaagtatttttattaaaatgaatggatcatgtccctgttatatacattaatgttcaagggacatgttatcaattaaaaaccccatcctttatgcaaatattaagtctttaaagtaatagtcctggaaattaaagagtggaaaggaggggacagccttatccagtgtccaggaagatgaagaagccaaaagattagtgacccttgctgtactgcaaaagggtttgagagtaggatcgtatccaaatggaatgagatgtgtgcagtaaatgcatactaatatgcaaggtacatgtttatggccattacagttttacgctgttcaggtttccttctgtagtgaacagaaaaaggcctactacaatcagtcattattattagcaagccacaaaatgggaccttataggtcaacaccacttctgtacttcaaagttaagagtaaaattgatcctactaaaattgccagtatgtacataaatagtttgaggaaggggtttcaagtgcacagcacatacataattccataaagcaaagaggatatgaatgatcagagacagaagtcttaccttgaaggaccattgaccgtattggaatcgtttcaatctatagtctcatgaaagaagctttatattagtgagcctctttgctttgctaagtacaggagtcctgatctaaaaggcacaactgtggacatgagaatatgtacaatagagttaacactgtgcacatttactatgttaaggatcttaaatactgctgcaatacaaataagtcttcaccagatgcagattactacagtgaaatgacatatgcacattcacaatatgaaagactgcatgcagggcatagtggtaggaaccagatatgccaacacttgttaaacgcaggctagatcctgagctcaaggctagcctgggttatatgctaagttccaggccagcctggaagttaaaaacaggacagatcaaaggtcttcttgattaccaacaaaatgacttgacttagtttggtttctttatccaatgcttaggaagagggacaaatgcagctgtgcacacaacaggcacaaatatgtttacattacaggtggcaatgcctgtaagtcccgcccagcccaggctacataagaggctgttctctcaaaccaccacacggtggggctgtagctctatgacagtgctttactagcgtacacaagactcaaggtttgattccccagcacagcagaaagaccagaacagagaagtggtctcattggttggcacccttgattgtcacccattagggtatgagggtatgggatcttggttactaacagaaggggacttgaacaactgcaattttgcacaattgtgtaagaggcattaagtaatcagcaccctctttacataaagcaagggtagtattaggaccttgagaaaagactcaattcctagtcaggattatccacataaaatgttccagtgcagaggtttttggctgaaataagaaagcatgtgagactagtatacaatatcatgagcaaataaatgtatctccatcagttagaaagatgtgacctggggcgatagcacccatgacagcatgccaacagtatatagtattctaccccctttaatggccaatgccttgaaaattgggactgagcactttaactgtctgataacagacctgtgtttgcccctttgctaaatgcacacagggctggactagctaaagtctaatccaatggacaaaatatttctgacagaattattcagtactcaaggtaatacatgagaaaagacgactgaacactgcttagaaacttgggactgtgactactacagcaatgacagaatggttttctttccttaaaggaaaaggagacttgagagatgataccctcccatggcaagtctctgatataaaactcttgtttgattggtgtatcttgattaacatgaaggacaagagttctttgtttacttgtccatggacaagtaaagtaggactgtatgcaaagtgaaattccatgactctggaagtcagtatggaggggtatggggtatagatgggctcagtcttataggctgagtgatgggcactgcattttagcaatacgattctatgcattaagtgaaattccatgactctggaactcagtatggagggggtatagatgggctatctcagtcttataggctgagttatgggcactgcattttagcaatagaaatctatacattatgtgaaattccatgactctggaagtcagtatggagggggtagagggtatagatagggatatctcagtcttataggctgagtgatgggcactgcattttagcaataggaccgtatgcaaagtgaaattctatgtctctggaagtcagtatggagggggtatggggtatacatagggatatctcagtcttataggctgagtaatggacactgcattttagcaatacgattctatgcattaagtgaaattccatgaccctagaagtcagtatggagggggtatggggtataaatgggctatctcagtcttataggctgagttatgggcactgcattttagcaataggactgcatgcattaagtgaaactccatgactctggaagtcagtatggagtgggtatagatgggctatctcagtcttataggctgagtgatgggcactgcattttagcaataggactgcatgcattaagtgaaattccatgaccctggaagtcagtatggagtgggtatagatgggctactcagtcttataggctgagtgatgggcactgcattttagcaataggactgcatgcattaagtgaaattccatgactctggaagtcagtatggagggggtatggggatagatgggctatctcagtcttataggctgagtgatgggcactgcattttagcaataggactgcatgcattaagtgaaattccatgactctggaagtcagtatggagggggtatagatgggctatctcagtcttataggctgagtgatgggcactgcattttagcaataggaccgtatgcaaagtgaaattctatgactctggaagtcagtatggagggagtatggggtatacatagggatatctcagtcttatagactgagtgatggacactgcattttagcaataggaccgtatgcaaagtgaaattctatgactctggaagtcagtatggagggagtatggggtatacatagggatatctcagtcttatagactgagtgatggacactgcattttagcaatacgattctatgtattaagtgaaattccatgaccctagaagtcagtatggagggggtatgggggtataaatgggctatctcagtcttataggctgagttatgggcactgcattttagcaataggactgcatgcattaagtgaaactccatgactctgtaagtcagtatggagggggtatagatgggctatctcagtcttataggctgagtgagggcactgcattttagcaatacgattctatgcattaagtgaaattccatgactctagaagtcagtatggagggggtagatgggctgtctcagtcttataggctgagtgatggacactgcattttagcactgaatcaatgaagattcgaatttctctaagtagaagtgggcttgggataggtctgaaagtatctgggcctggggctaggactgggctggggcagggctggactggattgggttggttgggtggggcaggggcaggggcaggggtaggggctggggctggggctggggcaggggcaggggctggggctggggcaggggctggggctggggctggggcaggggctggggctgggcctggggctggggcagcaatagcagcagcactatttgctgagtcttgaggagaatctagagccataaaggcaagaacacacagaaagttgaaatgtaggccttaatattactattataacagtaagtctgatagaggacacagagcattacaattcaaggctcttgctgacaagtaaaaccattagtcaatatagcatcaacaatagcaacaaaagcaaagcctgaactggtatagaacctcaaatactcctgacatccagtcataatgttcactttacattaacagtatctgtgttataagacttaaaaatttgaagagtagctcggtggatgagtttgaaagaaagtacatttaagtgccaagtaatttgagtatcatctgccaaaaaaattattgaaaactttaaggactccaaagtaacaattcactaaaggtaattaaaatgaattcaacaagtaagcaaatccgtaaatacattttgaaaacaatcacttcggttttaaattcaaacactagcaaagcacactatcagacgtgtcgttggcatccaaaatattcattgaaatcaaaatgcaaccccagcaatagtcatggggtagattttggaagaaggtaggattctacctcttcaccagtgatttgtgatccactatgactctggccaaagtcaccacttatacccagtaggcttagagaaccgcttgagatcagtgctggctaaatagaggccaaggtgtaagtagactagccactgaacaatacaaaggaatggaacgggctgagttttagtttgcaccgccacgtatagagcactgtaagagactatgaacgcaagcggatgagtcaaatgtccttgaaatggccttagatacttttctttcttttaataggtgaggtttcaatgatttacatcgaccaagaacccgcagcctcggtctctcgaatcggatccgacatcatccaacacttcagtgttagaattgcaagcatgcgctctcccgacctgggcaggcacttcgaaaaaatgatgactaaagacacacgtgaagtaccaagcgaaactcacgtccttatgggacagtgactcatcacagtctaattccatcctggccaccaagcaataatgcacatttctaactggaagtcaagcaaacaccaacactttcacacttgtgcccatttctgacgagttacgtcaagtggcaaccaacacttccacttagccttgcctcagcttcgagtggcacaaggtaggaccaaccacaccctaccataatgcaccaagtgtaccctcgggcaaagcccgccaagtagctaaagcccgccaaaaaaaaaatcactgaaagaaaccactagagggcaggtcacatgacttccgccatcttagacacattcaagagcatgtgccacctctccaggctaactcagacatgaagctgacatgtgacacacaaagccctttgcgttataccgcaccaagaacttgagccgccatcttttcctgtacgacctaaatgtcctataatccattgctacacaccagaacaaagattgggctgtcgagcctcgggtggagcccccgagccgccattttatagacttctgagcagcccttaaagccacgggggaccgcgccaggggtccatatgcacacacaccctgcccaatccccacacccacgctgagccctatcccctagtcctctgcggcttccgcgcaacaccgcacactaatacgagcactccttggctttctcttccggctagcacaaccccgcaaatgctaccacaaatcaaggcgaatcccgcaaccccgcacatataaagaaagcctttagctagcgcagcgcaattggttgcttttatccagtccgctgtgctcctcggtgtcctaattcttggcgtaactggctcgagaatagccgtatcacgcagaagccataatggcggacgcgggctctccacgccctgaacacccactcagtttaagagcaaagtcgtttttctaagccataggttcactcacacagcaccaaacgatcagcagcaacagtacacgcaaataagaggcatagatattccaggtagtgcaataactcacaaaaccatatttccatccaccaagccccgttgggcctgtaaaaaaaaaatttaaagcaggtatccacagccccgatgggcaaaagaaaaagaaaaaaaaataataacagcaggtatccgaggccccgttgggcatgggaaaaaaagactaaacgcaggtatccgaggtcccgatggaccgagaaaggtttttttttttttttttttttttacaaaaagcaggtatccatggccccgatgggctaaggagaagaaaaaaagaataaaagcaggtatccacagcccagatgggcaagtttagaaaaaaaaataataagaaaaaaaaagaatgaaaaggcaggtaagtatccaaaaccccgttgggcatggaatggcggggaggacacacaggtatccgtggccccgatgggcaagattatataaacaatgaaagaaaggtaagtccaccatacacacacaagtatcaaccaaaaggcacaacaaagaaatattccttaaaaatgaaaaattgactgaaaatattacaaatatcaaaaagtatggaggacatgtcaaaaaaaaaatcttaccagaacatatcaaaacgtcaaaaatctcgtggaattttgatatgttttcttaaataagccataaggcttggtggtaggggaactaaaaatgttcccccaaagctccttagatggagagaaaccacggaagaaccgcacatccacgggaaacgagcaaacaggctggagcaagccgttgcacgcctttaactgatccgcggcgctgaaggcggagagaccagaagaggagtggccacaaagattgcaattctgacatcttattggacctttaggtctaactatattataaaaaaattaaaatgaataaagatggaggtacgtaagctcagtgacatgacgcgtgaatttcattattttgcgcgataatgaaggattatcctattttacagctaaaaacgtttatgtagaacttcacataaacatttgggtgtgtacatttagcacacacctgtctatgcaaaatttcaatatatcttctacttggacaaaccatgtgtcgctccggtcttggacactagaagttcttctgcattagttggcgacctcagatgaggagaggaaagggtagaaatgcctcacaaaatggctccttggttcctaaattatcagagtattagttgtgaccgatttggagggcttacgctcatagttttgggtcattggcatcttagtctttctctgggaacctggtgactccataccttgggacaaaaacgcactgaagacgttactagctagcagtaatgaaaaataattcctaaatgccaaagcaaagccttagggaataatagctcattggtatcttactcgccccagagacactgctaacttaaaagaactgtcaaattttgttaactgtcaaactatgaatatccacatgaaagagatcagacaccctgggtattagaaaatcaaaggatatgttgtctcgttgatcacgctgacaaataattcacagtctgttctaagttccctttaggcgtcccatgaataataaaggacacaaaattggtttgcttatggacgatcaaagtgccagcaattcagtaatcttactattgaggtggttcaggtagggatggaaaaatatctgctacaaaataaacagtttcaaccaaaagaaaaacaaattaacaaggtaaataaatgatgcacacagactgaataaaccagcaggtggcagcatgaatctttccaaggcatctgaagccaaacttggagtgcaaaaggattcctatctgaattgagaagtaaaggttactttgtctaactttagttgacagagcgatcaggatcagagtaacaagcacaccaaaagcatcaccagtgagaagtcacataggacatattagggaaaaaagacccaaggaagggctcttcacagctaagagcacctggctccacgatggatatggctttgtataaacgagaacttctaaatgagctgtacaaagagaatttagaacttgcgaggtactggtcacagattatgcaagccagtgtatcatttttgtggggatgctagagagaatcatcaaattaaagagttaaatttagtctctgtgttttacttagtcccaattcttgcaaaggtcatcattctttctcacaccgtgtacatcaaggtatgtcaggtttcggggacactttttagtcttatcacaagaaagcatgaagggatatgtgctaaaactcagttcctgggctggagagatagctcagtggttaggagtgctgactgctcttccagagggcctgagttcaattctcaacaacttcgttgtggctcacagtcatctgtagtgggggatccgatatctaaccttcttctgatgtatctgaacagtgaccgacagtgtactcacattaaataaatatttttctaaaaaacacctccattcctgtacacttaactaggtaatttattgcatagctttgtttgtttgtttgttttgtttttcaaggcaggttttctctgatatgccccagatgtcctggaactcactctgtagaccaggctggcctcgaagttagaaatccacctgcctccacctcccaagtgctgggattaaaggtgtgtgccaccactgcctgcctcattgcatattcttaacattaagattaaaaatgcacctggggtaaaatagtaatcttgaggaattctccatgcaaattcaaagaggagaagaaggaagaacaagatgatgatgataatgggtcaagaaacaaggacccactacaaagcagcaagaaacagaaatgggagttaagaaatggtcttccaatgtgcagaggtaagagactttagaacacttggtcctagatgagatgtcttcatcaagccctttctttcaatgctcaggcatctatgaagataaggagtcagaaagactgcagacaaaacagcgcagttttcgttttgtttttaagaaaatgaagtatggatttggatgagtggggaagagttggaggaaggaaaaatgatcaaaataaatcatgaaaaatggtttgtttttttaaaggaaggatgttcaatgacactactggctctgtgaacagagagaaagttggagccacaactataggtgatcaggcatccagtctctccaggaaatctatatttttttcaattctaacgtatattgggagaggggttgatctggtataaaatggttgaagaaacactcccaagttcatgaatcaacataatattgtctaagttgcatcaaaaacccatctatggatttagcgctatactcagcaaaattctaatgacattcacataaatagtttttaaaaataggtgacatggtaagtagcttatgcctgtgaatcccagcccttgggagttacaaggatgtaagcttcaaatgaatgaacaggttgcaccacagcgtcaacatgctactgctcataggtaggcttgtaaattagtgggatagaatagaggacctggagacagccatccactactcaacaaaggtacaaacaccacatgtaagagacatacagtcacttggccaagtgatccttagcatagtggtactatctcaccctatacagaaatcaatctaccaaagatcatgtaagaacaatgactcctacagcctcagacattttatcactaagccatcaggagcggggaggaggtggcactactttagaagaattaggaaggacataagtcactagggagtgggctttgaggtttcagaagcccaagccagggccggtggttggctttcttcctactacctgtggaaccagatgtcaaactccagtactatgtcttcttgaatgctgacatgctccctaccatgaagacaatagactttaaccctagaaaatattagaaagcccctttacaatgctatctcttaaagtgtggtcaaccaggtggacgtggtgcatgtctttagtccccagacctaagaagtgatcaattatggtgcttaagactgctcttagattactcttgagatgcttaatattccagatgaccaaagttcaagatttacactcacactagacaaatctttactggctgtaatttcagtgctaagggatctaaagatcaggctttcatgtgcaacttcacagactttattttaagataacaaaaaacaatctccagcacctcataaaacaggcataccaacttataagttatagtaatagaaagtgaagagtccccagctccaagtcccggaaaaatatcaacaaaatcagaagaaaattttcccaacctaaagagatgccaccctttcccctggctggcagcatggaggctgaacgatgcctgaagtcactgtaaaagatgttaaccatcaggttcgtcagagcgctggcagccttcctcaaaaagtccaggaagctgaaagttcgggaatgggtggacacagtcaagttagccaaacataaagagcttgccccatatgatgagaactggttctacccacgagctgcttccacaactccggacctgtacctctgtacacaactgtagtgcaggagttggttccgtgaccaagatctatgaaggatggcagaggaacggtgttaggcccagccacttcagcagaggctctgagagtatggcttgccaggtcctccaagccctgaaagggctgaaaatggtggaaaagggccgagatgggggccgcaagctaacacctcagggacaggaaacacatctggacaggatcgctgaacaggtggcagctgccaacaagaagcattagaaaaaataatactgggttaataaattgcctcattcataaaaaagaaaagaataaagaaagagaagcctataaacataccagaagcttatagagtaccaattataaccaaaaaaaaaaaaaaaaaaaaaaaaaaaaccaaacaaaacaaaaaacaaaaccctcctggcatgtaataatcaaatgtaaatacaaataataatgttttggagaagatgtaatgatccattccattaatacgagcacttgggaagcagagccatggtggatgggtctcagaggagtgtgaacttaatgtgggcctctgctgtagcagcaagtgttcttagctgctaagccatctctgtggcttcttttattccaaggactgtttaagctgacctggaattcactatgtagaccaaactagccttgaacttatggtgaacttcctgcctacaaagtgttgtgcttacaagcatgtgctaccggtcacagatataagtgataagtataagtgttttattatatataaataagtaaataaatacatagattctatatctgttcttccacttgccacatcagtttttcccctctcagctcatactccggattacatactccggtgttatagtcttggcacaggagcaggcaatgcaagttgatggtcacaattatgcaacctgaggaatcctcagaaccgcagagttctctctagttatatattgttgtgattcttgatttatattacagaaaacttaagaatgcttattgaataagatgaaggaaagatatgagtgggtattgggaggggcatggactgaagtccagcagtagtagctatatacctgatttgtttttttttaagtttctgttatttaaaggaagtattttataaccaaggttgagagagcaaagaaaacatttgttcatcttcccactctacccttgccttttccatttttgtgtgtatatgcattttgtccatagatgtggatacacatgtatataggttcatatgtatatgtgtgtgaatatataggcctaagtttaatgtcttcaatcatttttctaccttgtttactgaggcaagatcttagccaaacgagagctcactgatatggcacgtcttgttaggcaacttgctctggggatccctgtttgagcctttcatagctgcaattataggagggcttcacatgggttcacgccttggggacttgaactctggtcctcatgcttttatggcaaatacttaacctctgagccatctctttagatccccattacatcattgaaaagtattgagtttttaaggtttatttctgactttagttatgtatatggtctgtgtgtgccctcaaagaccagaagagagcagcaaagcccctggagcggaagttataggtggttgtcaactgcctgatagtgctgagaatcaaacttggattttctgaaagagtagcaaatgtttgtaagcatcgaggtatgtctctagtcccaggtttgtttgtttgttttatttaaatgacgttactgagggtactggtgaggttgcaatatgaataaaagagatgtgattaagataaacccatggaatgtgagcagtggaggtgcacacctttaatcccagcacttgggagttagaggcagatggatctctgagtttgagaccagcatagtctaccgaggcagttccagtatagccaaggccacagagaaaccctgccttgaaaacaaacacaaacaaacagaaagagtagataataatacatttggggggctggagagatggctcaacagttaagaggattcgctgcttttccagacgatccaggttcagttttctttaaagaataggccactggcagtttgacctcacgagctaataatgttttatataacatggagtaacttagagtagcataacctgatgacaaaggtggtcaagtggtaagagccatagaagggttcaacgaccctgcccctatcgctggagtattgagatttaaactaaaaataggagagacatttcaatagagaacaaggagtacccataataagtaattttcgcttttttcccctgccgccaccaatttgcgcggaggcagaagctcaggtgcgttcaagattcggcgtcacccataatccaccgccatggccgaggaaggcatagctgctggaggtgtaatggacgtcaacactgctctacaagaggtgctcaagaccgccctcatccaggatggcctagcacgtggcatactcgaagctgccaaagccttagttagacaagcgccaagcccatctctgtgtgctcgcatccaactgtgatgagcccatgtatgtcaagctggtggaggcactttgtgctgagcaccaaatcaacctgataaaggttgatgacaacaagaaactaggggaatgggtaggcctctgtagaatcgatcgagaggggaaaccacggaaggtggtcggttgctgttgcgtagtggttaaggactatggcaaagaatcttaggccaaggatgatatcgaggaatactccaaattcaataaataaataaattgtagctcattatgaaaaaaaagtaattttcttcgaggtgtagcctgactaattattgtgtcttgtggtactgcaagatagcccagagaaaccctcatcttgactggccatggtagcacatgcctataatgggagcagaagaattgctttgagcttgagaccatactatgtcttgagagagttcttgtttttttaaagggtggctcatgtttgaagcataagctgattacttttgccttgcatcatggataactgccctcatatggaagaaggtctgtcctgggaggttttgctcttggagttcaacatgactaaggatgaatgaaataatttaggaagacactccttctgttattaatatgcctatgcacagtcaagcaggagtttgaaatgaacggaaagacagactcaaaatgaaggcagagactcaagtctttaatcctgtggttggttaccttgtgaagccaagtaggccatcaatacctttagcaaaagcactttctgaaaacctgttctaacaggacataaatttctaacaacagtgcaacttaaattgtaagaaaacacaggactgtttcaaagactgatagcatgttgtttcctatgtttcatatacagcctcatggtttgctttggctttgctctccacccctctttcacgtggtctcatgtaattcaggctgatctggaacttactgtgttgctgaagatgagctgaactcctgatgctccttcctaactctctcaaattctggaattttaggcaagcaccactttgctcagcttttctttgattttcatttagaatattaaagaatagttttatttaatcccaccattcagtaggcagagtcaggaggatttctgattcccagtctggtctacagagcaagcttcaggacagccagggctacacagagaaactctatcttgagataccaataaagaaagaaagaaaaacatttttcttggggctggcaatatggctcagtggtagagcaatggcttagcatgtaattagaaaatcatggattcagtccttagtaacacacacacacacacacacacacacacacacacacacacacacacacacgggctgagtcttgactgcaagatggctcagctgataaggagcttacctcaaagcctggcagacaccctgagctccatccttggaaactatgtggtggacacatccatatattctctctctctctctctctctctctctctctctctctctctctctctctctcccttcttctaccccgccttggtctttctcaaacacaaaaataaataaatgtaaaatattgtaagaagttataggtcatttatataaagaaaattaaaggaaattaaggaaatacttttagatgagaatagagtataaggtttttatcctaaaactaaaagattgttcccatatggacaaaaaggggtgatgagggaaaaaaccagaaagttttagtctattgccaaaggcctgagtatgtcacaagaagtttgtagaagataaagtgaggcccggggaaggaaggagaattgggaatttacagtcattctctgctacgtaataagtcgaggccagcctggaataacgggggccctgtctcaaaaacagaagagcaacaacgatatgcatgcctgaaaagccaaatctttaaaaattagctagagtcacactttcctaggtacttctttcaacagttttgccacagacattagaatgaagttggaaatgcagacagttgggctcccagataccctgaatcaacttttatatttgacttttgttttttttaagtttataaaaacttttttttttttagaatttttatgtgtgtgagtgttttgcctgcatataggtctgtgtaccacactcgagcatggtgtcagaggaggtgagaagcctcatgcagctgctaggcattgaaccccagtcctttgtgagaatattaagtactcttacacaccaagccaactctccagccctgcttttggggtgttcaacaacaaagataagtagaaaccaaatacgcacccagagaaaaatcacatatatacaaaaagccagaaatttgagaggcaatgtgtgtgtgtgtgtgtgtgtgtgtgtgtgtgtgtaataattttcacaaacttgccatctcagagaaactctaggaggaagaaaggattccaaacaggcaaattctggctacagctgaggagagctcgcacaggaaagaactgcctgtaatggaatgaaaagaagccagggctttgctgtcttgggaaagagggaaaccagtgtaagggaaaatgtgctaccttctggagagaggacagccctcggctccatgacagctgtcccaggttgccttagcaaagccttcctcaagcagatattcactgaggccccttcggcaactttccaacatggttttacttaaatacacacacacacatgcatttacttcgtgtgtgtgtgtgtgtgtgtgtgtgtgtgtgtgtgtgtgtgt

SEQ ID NO: 7 - DNA, 4929 bp, Mus musculus
gtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgca

SEQ ID NO: 8 - DNA, 4800 bp, Mus musculus
tcgtgggtagaaccagttctcatcatatggggcaagctctttatgtttggctaacttgactgtgtccacccattcccgaactttcagcttcctggactttttgaggaaggctgccagcgctctgacgaacctgatggttaacatcttttacagtgacttcaggcatcgttcagcctccatgctgccagccaggggaaagggtggcatctctttaggttgggaaaattttcttctgattttgttgatatttttccgggacttggagctggggactcttcactttctattactataacttataagttggtatgcctgttttatgaggtgctggagattgttttttgttatcttatataaagtctgtgaagttgcacatgaaagcctgatctttagatcccttagcactgaaattacaggcagtaaagatttgtctagtgtgagtgtaaatcttgaactttggtcatctggaatattaagcatctcaagagtaatctaagagcagtcttaagcaccataattgatcacttcttaggtctggggactaaagacatgcaccacgtccacctggttgaccacactttaagagatagcattgtaaaggggctttctaatattttctagggttaaagtctattgtcttcatggtagggagcatgtcagcattcaagaagacatagtactggagtttgacatctggttccacaggtagtaggaagaaagccaaccaccggccctggcttgggcttctgaaacctcaaagcccactccctagtgacttatgtccttcctaattcttctaaagtagtgccacctcctccccgctcctgatggcttagtgataaaatgtctgaggctgtaggagtcattgttcttacatgatctttggtagattgatttctgtatagggtgagatagtaccactatgctaaggatcacttggccaagtgactgtatgtctcttacatgtggtgtttgtacctttgttgagtagtggatggctgtctccaggtcctctattctatcccactaatttacaagcctacctatgagcagtagcatgttgacgctgtggtgcaacctgttcattcatttgaagctttgtcatgtagctcaatctggtctccaattctctatgtggctatttctgatcatccttgtaactcccaagggctgggattcacaggcataagctacttaccatgtcacctatttttaaaaactatttatgtgaatgtcattagaattttgctgagtatagcgctaaatccatagatgggtttttgatgcaacttagacaatattatgttgattcatgaacttgggagtgtttcttcaaccattttataccagatcaacccctctcccaatatacgttagaattgaaaaaaatatagatttcctggagagactggatgcctgatctacctatagttgtggctccaactttctctctgttcacagagccagtagtgtcattgaacatcccttcctttaaaaaaacaaaccatttttcatgatttattttgatcatttttccttcctccaactcttccccactcatccaaatccatattcattttcttaaaaacaaaacgaaaactgcgctgttttgtctggatggtgttttcttggagtcatttactgcagtctttctgactccttatcttcatagatgcctgagcattgaaagaaagggcttgatgaagacatctcatctaggaccaagtgttctaaagtctcttactctctgcacattggaagaccatttcttaactcccatttctgtttcttgctgctttgtagtgggtccttgtttcttgacccattatcatcatcatcttgttcttccttcttctcctctttgaatttgcatggagaattcctcaagattactattttaccccaggtgcatttttaatcttaatgttaagaatatgcaatgaggcaggcagtggtggcacacacctttaatcccagcacttgggaggtggaggcaggtggatttctaacttcgaggccagcctggtctacagagtgagttccaggacatctggggctatacagagaaaacctgccttgaaaaacaaaacaaacaaacaaacaaagaatatgcaataaattacctagttaagtgtacaggaatggaggtgttttttagaaaaatatttatttaatgtgagtacactgtcggtcactgttcagatacatcagaagaggttagatatcggatcccactacagatgactgtgagccactacgaagttgttgagaattgaactcaggccctctggaagagcagtcagcactcctaaccactgagctatctctccagcccaggaactgagttttagcacatatcccttcatgctttcttgtgataagactaaaaagtgtccccgaaacctgacataccttgatgtacacggtgtgagaaagaatgatgaggtttgcaagaattgggactaagtaaaacacagagactaaatttaactctttaatttgatgattctctctagcatccccacaaaaatgatacactggcttgcataatctgtgaccagtacctcgcaagttctaaattctctttgtacagctcatttagaagttctcgtttatacaaagccatatccatcgtggagccaggtgctcttagctgtgaagagcccttccttgggtcttttttccctaatatgtcctatgtgacttctcactggtgatgcttttggtgtgcttgttactctgatcctgatcgctctgtcaactaaagttagacaaagtaacctttacttctcaattcagataggaatccttttgcactccaagtttggcttcagatgccttggaaagattcatgctgccacctgctggtttattcagtctgtgtgcatcatttatttacttgttaatttgtttttcttttgttgaaacagtttattttgtagcagatatttttccatccctacctgaaccacctcaatagtaagattagtgaattgctggcactttgatcgtccataagcaaaccaattttgtgtcctttattattcatgggacgcctaaagggaacttagaacagactgtgaattatttgtcagcgtgaatcaacgagacaacaatatcctttgattttctaatacccagggtgtctgatctctttcatgtggatattcatagtttgacagttaacaaaatttgacagttcttttaagttagcagtgtctctggggcgagtaagataccaatgagctattattccctcaggctttgctttggcatttaggaattatttttcattactgctagcgagtaacgtacttcagtgcgtttttgtcccaaggtatggagtcaccaggttcccagagaaagactaagatgccaatgacccaaaactatgagcgtaagcccaccaaatcggtcacaactaatactctgataatttaggaaccaaggagccattttgtgaggcatttctaccctttcctctcctcatctgaggtcgccaactaatgcagaagaacttctagtgtccaagacgcggagcgatacatggtttgtccaagtagaagatatattgaaattttgcatagacaggtgtgtgacctaatgtacattatttaatgtttatgtggaagttctacataaacgtttttagctgtaaaataggataatccttcattatcgcgcaaaataatgaaattcacgcgtcatgtcactgagcttacgtacctccatctttattcattttaatttttttataatatagttagacctaaaggtccaataagatgtcagaattgcaatctttgtggccactcctcttctggtctctccgccttcagcgccgcggatcagttaaaggcgtgcaacggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattct

SEQ ID NO: 9 - DNA, 4317 bp, Mus musculus
ccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttag

SEQ ID NO: 10 - DNA, 3695 bp, Mus musculus
ctttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttcctt

SEQ ID NO: 11 - DNA, 5880 bp, Mus musculus
gcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaa

SEQ ID NO: 12 - DNA, 1563 bp, Mus musculus
actttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacaga

SEQ ID NO: 13 - DNA, 34 bp, Artificial Sequence
  synthetic
  misc_feature (6)..(7): n is a, c, g, or t
gtgaynncccagrtccccggtggcaggcatttta

SEQ ID NO: 14 - DNA, 68 bp, Artificial Sequence
  synthetic
  misc_feature (6)..(7): n is a, c, g, or t
  misc_feature (40)..(41): n is a, c, g, or t
gtgaynncccagrtccccggtggcaggcattttagtgaynncccagrtccccggtggcaggcatttta

SEQ ID NO: 15 - DNA, 19999 bp, Mus musculus
tgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctccaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttatttaaaaacaaaaacaccattaaaaaaaccaccacaccaggccaaagccatatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgccattataacatcacatacacgtaagattttgttcctattcactcccattactctctttttttctccctctcacttttactgatccccttactctgctcacacacttctgatttctggtttcttctatagcatggatgaagggttatttacaggaacatggcagattcttaccgaagaaagtatccccccctcccaactccctcagcaaacaataactactaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcagatcccattagggctgatcttcaacaatcacacaatcacatattcttttttgtttgtttgtttgtttgtttgtttttttgagatagggtttctctgtgtagctctggctgtcctggaactcactctgtagaccaggctggcctcgaactcagaaatctgcctgcctctgcctcccgagtgctgggattaaaggcacgcccagccaatcacatattcttatgactcagagctaaaagtctgcacgaacagaaactagtcttaccaaagctgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcagcttggcctgtgagtaaatctgtgggacattttctcggttaacgatcgactgggggggggggcagtccacttaaaccatgtgggtggagccacccatggacaggtggtcctgggaggtatgaaaaagcaaagtgagcaagccatggggagcaagccaggaagctgtcctttgtggttcctgccctaatttctactgtgatgtggaagtacaagccagataaacctttcctacccaatgtatttttggttagaatgttttatcacagtaatagaaagcaaactaaaaactaaaacatctttctaactttcatgccacagtttctttttcttcctttcttttttcttttctttcttttcttttcttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttaaattaaaaaagttgaacctaggtgtgttgtctcgtgcctgtaatgcccatgttcaggagagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacaggcagacacggtaacagcctcttcatgcatgcactagctcacacacatgagtgcgcgtacatcacaaacacaagcacacacaataaatacatttaaaagttttttctttctttgtaagtgtgaaaattacaaattgtagaattttgatccagataagaggatcaggagtttgaggctagcctgggctacataagaccctgtttcaaaaaccaaactaaaccaaaacacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattcatgcttgtttacgaacaagacaagtaaaattcctcgagtctctgtctcttggaataggtctttccactgtaggtgggagggaaatgtttccgtctcccaagtgctggaatttaaaggtgtgggtctggttgaactcgttttttgtgtccttcagtggtcaggtgccccggctggtgggtggggtgggaggaggagtatctgtctctattgttcctggactgatcctgaagtgtaacggaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccgtcctgatctacagagagagagagttcaaggacaaccagggctatacagagaaaccctgtctctgggggggaaaaaaagcaaggaaaaaaggaaggaaggaaagaaagaaagaaatgaagagaaagaaaaaagactaataggtcccagagactcccatgacagtgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgtaacatgctgccacggtcctccctgtcactgctgccattgggctatggcctggtgtctgtactcaaactgaaaacttgcaagctagcacacgtgctggcggagtgtggacgcacgggtacacgtgcgcacgcatgaacacacacacatgcacacacgcgtgcgcacagacacacacacacacacacacacacacacacacacacacacacacacacacattttgcgcatgcgtacagatatgtgcgtgcgcacacacatacaggcacacgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacgacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagtttgaagccagcctggaaaagatggccagattatgactgtttttctaaataataagtaaagaaataaagaaaaggagaataacaaccaagcatggtgataaattcgtgacctcatcttctatgtatatgatgtaaaagtcatgaagtaataacctcttacaatattcaagtagtagctttacttggaaagaaagattttaaaagaaattttatttttagacagtcaaaaatataattaagaagtatcgtatctgtgctaagcagacaatataaaattcgggaacaaagaacatatatctttatctgtttgcttatttttatttatttatttatttacttacttacttacttacttacctacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccatcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacaaagtgagttccaggacagccagggctacacagagaaaccctgtctcgaaaaaacaaaacaaaacaaagagtactgactgctcttctagaggtcctgagtccaattcccagcacctacatggtggcttacaaccatctataattccagttcttaggggacattgacaccttcttctggcttctgtggacactgcacagatatggtacctaggtatggcagccaaaacacccaagcacataaaataaagataaataaatatttttaaaaagggggatgggggtggacagatggctcagcggttaagagcattgactgctcttccagaggacctgaattcaattcccagcaaccacacaaccatctgtaatgggatctaatgccttcttctggtgtgtctgaagacagctacagtgtactcaggaaaaaaatagtttttttttttttaagaaagaaattcagatatctgctgtattgtactctttattactgccaggacaaaatgtccagaacgataattcaaaaatagcccactgactttccacgtgctagaaggtagaaagtgatagcagatttcatgccatgcagatgatccctgtttccacagaggtgcttctctcacaagacagaagaaatggaagagcaaaagacacaaccaggagtgtacttttagctgttcttacaaggacagggacagtaatcgagtcatggaggcattaccaaatacatccaaaaaggccttatctttcttgttgtttttgttcggttggttttggttttgaggcaaggtttttcggtgtagttctggctatcctggaattctggagtcaggctgacctcgaactcacaaagatcctcctgactctacctcctgagtggtaggacaaaagccgtgcaccatctgatcaccctactcatgatgtgtgcatgcacacacactaataataacaagcaaaaaatatctttaaaaagtctaaaaccacaactttgagacagacattaggtagacatacttattccaaaagtcagaaataggaaagaagaaagggataaattacgccaaataagccccagacatggcagggcaagagttcgttctgtgtgcgcacgtgctccaaagtgtttcattacagttgctttcagagtcctgggtgaggggattatttgtaggagaatggactccctacaagtagttacacactcagatcttctctccctttctcaccaactatagaccccccagggaggggtggggtaacatcagctcctcccaataggggaaggttttgttggtgttgtgttgtgttgtgttgtgttgtgttgtttgagacagtctatcactatgtagcctgattggcctggaattcatcaggtagaccaggctggcatctaaatcagagattcacctgcctctgtattttgactgctgggattaaaggtatgtacaccaacatattcccctaagaggggatggatcccagggtctagatgccattgctctctctcccctctctctttataaatatagttttaagatttttacttgtatttatcagtacagggggtgggttgctggagtatgccagaagagagtattggatcgcttggagctagagttacagggaattttgagacatctggggactgaatataagtcccctgaggagcagcaccccaacatggtaatacttcatcttaaggctcaagagcaaactttggctccaagttctgcctctagacacacggagcgccatttgggttcacagggctctaagcttgcctcgctaggcacgctgacacagcacttcttgtcagtcggaaccagttgctggcacctctcccaagctgtttttgcatactggtggctctatagctctggcgtcataactgagagcagtgttttcatagctcttttgggcattgctctcattgggggtctattctctgggcaaaagtcgctaagcactgtgctggtagagactttatatcagccttcctctggttctctgcttggctctcaaaactcatggaggaatcctttgaaatctaggtgaagctagtcatgactccacagctcatacgtttggaggcagcagttccttgctaaattctactttgtgtgcattaatgtctcctaagcaagtctagtagaaaatcctttataatatcaattgtagtacttcaagtttcttccgcatcacggcatcggctgagtaacagtcccccagatagatggaacaatagaagattacaaagtgagaaaaggaaggaagtagaaaaactggtgtttacttggttccagctgttttctgattcaggaagaaaggggccgggcatactctacccatttatagtaagaagatttttttgttttggtgggtttttcgagacagggtttctctgtgtatccctggctgtcctggaactcactttgtagaccaggctggcctcgaactcagaaatctgcctgcctctgcctcccgagtgctgggattaaaggcatgcgccaccatgccaccacgcccggcttgtagtaaggagatttaactgtaccatgtaaggcaagagctcctcatgtcagagttcaaaaagtaaatgtgctgaaccatcacttggtttagaacagcttaagcccccagcccccactccaccccaaaccaacccttgactgtttaattgctgataaggaataaaagccctttcctataaaccactgtttgtttgtttgcaacgaaatcagagatttactatatggatatttaaaaattcagaatttgggggctagagagatggcttagaggttaagagcactggctgctcttccagaggtccagagaacccagtttcaattaccaacaaccacatacagatcacagctgtctgtaacttcagctctaagggatcctataccatcacacagatatggatgcaggcaaaaaagcatcaatgcacatggaataaaaataaataaaatttttaaaatttggaatttacaaataatgaagatccctcactggttcagccactcaccgaggtacctcactccagcaatttcccctcaccagacttattcatttttaaagtttagatgtttgaatatttattgtaaaacagcaagcacaatgatttctatttttataattggtgacgtgatctggaaaaatacttctaattggtaaggcaagagtgattgcaatgcactcttcatttttttctaacttcttaaagtatcttcttttttaaaattaaaactttattataggggctggagagatggctcagtggttaagagcactgactgctcttccagaggtcctgagttcaattcccaggaacctcatagtggctcacaaccatctgtaatgagatctgatgccctcttctggtgtgtctgaagacagctacagtgtacttagatataataaataaatctttaaaaaaaacctttactggaaggagttacagagacaaagtttggagctgatacaaaaggatggaacatctagagactgccatatccagggatccatcccataatcagcctccaaacgctgacaccattgcatacactagcaagattttgctagaaggaccctgatatagctgtctctagtgagacttcgcctgggcctagcaaacatataagtggatgctcacagtcagctattggatggtcacagggcctccaatggaggagctaaagaaagtacccaaggagctaaagggatctgcaaccctataggtggaacaacaatatgaactaaccagtaccccccagagctcgtgactctagctgcatatgtatcaaaagatggcctagtcggccatcactggaaagagaggcccattggacatgcaaactttatatgccccagtacaggggaacgccagggccaaaaagtgggagtggggggaagggtatgggggactttttggatagcattggaaatgtaaatgaggaaaatacctaattaaaaaaaaaaacggggcctagcaaacacagaagtggatgatcacagttagctattggatgggtcacacggcccccaatggaggagctagagaaattacccaaggagctaaagggaactgcaaccctatagatggaacaacattatgaactaaccactaccccggagctcttgactctagctgcatatgtatcaaaagatggcctagtcggccatcactgcaaagagaggcccattggacttgcaaactgtatatgccccagtacaggggaaccccagggccaaaacgggggagtgggtgggtagtggattggggggggtgggtatggcggacttttgggatagcattgaaaataaaaaaaaacctttactataaaaaaacttgcaaataaaaaattacccaccggagctaatgaccagatctttaatagttttgttttttatattgttatagtgtttgtgttctcagcacacttaacaaaagcaacagaaaatataagaaattaatctactcaactaaactaattaaagtttattttgagacaggatctcactatgtagtcctgaactggaactcactatgagcagctggcttttaatttaaagacccacaggtttttgcctcttttgcctctggagtgctgggattaaaggcatgagccagcagcatcccagactacattttaagaaagggaaaaaagctggtcgccgggcatggtggcgcacgccttaatcccagcactcgggaggcagaggcaggtgaatttctgagttcgaggccagcctggtctacaaagtgagttccaggacagccagggctacacagagaagccttgtctctaaaaaccaactaaccaaccaaaccaaaaccaaaccaaaccaaaaaggaaaggaaaggaaaaaacgaggtaattagcataattagcatgacaaggaaggggtagtgagaaacagtgacacagaaacgcaaaggtttcaagcagaatttattggaagtttggcaagcaacaaacaccctagttggcctgtagatgactttagattgttttgcggtgattttcattttgaagaaggatttccaattttcaaaacagccaggctcaaattaagtatttcccatttattttagcagtttggtatagatttgttttcggcttagtgtgtagagatgtttgtttgtttgtttgtttgtctgttttccatcaggacttcatttatgcatgagggcacaatggtagctgatggtgacacgtttctgcctgcctgcttaatcagtt

SEQ ID NO: 16 - DNA, 5564 bp, Mus musculus
ttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatct

SEQ ID NO: 17 - DNA, 1223 bp, Mus musculus
aaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattt

SEQ ID NO: 18 - DNA, 10890 bp, Mus musculus
agtatgcttgcttgcttgctttttaactgtcagaaagagcaaattctgtataccagaaggccaaggggacaaaccttctgggcttggcaagtacaactgggagatctaaaggtctgtacagtcagttgggaggaagagccaacctcttcagtaagatctcggtaactgtttcaacttaagaagaccaataccagaactggaggcactatgggtcacctccatagcccagtgaaaggaagagcaaggaacaggtagatctctccccaccaacgtatatgtatgcatatacagacagccatgaactagatcacagacattttcttagcttttcatcctagctggggggagactaggcaccagcatagttttcaattttcagtggtgatgtgacagaatattcactgggcctttagggtactacagaaggctgtcattctctcatcatacatccctacctgcaccctcttgatccacatccccacctccagcccaattcacagcccaccttatatgctgcatgagtagtgctaggaaatctaacggtctgggcctgtccctggaaaggaaagccagggtcagaagtgaggtcttggcacccgtagaaggcataaagaagtctgttataaaacccagtgattgggagaacatagggacaattcaacccctcaatattaactgggtcccagacattttcttcacagttccaacctaactgaaagagaacttagacaccagtattttctaggctctccaaccacaacgaaccttcaggatgtgacagagatgtgactttttctattcttaccccactagaacccctgtgctaccctccccctcccccagctccaccctcctatctccctctactgcaccctagtcccacttcgtgtttctcaagcactacttcaaaatcaaatggtaaggtaagtcaaggttagcttaggtgccttggcttcattctgtttggtttagttctgtttgttttaggaagacaatcaatatccccaataaggttttaagatctttataaagaagagatgcccagtacttgatctagtggaagaaggactatagatgcaaatctccacaccccaacaacaatgaccaaaaagtcctgttttcttagcttttccaatctaggtgagggagagtgtacatcagtgttttcagggtcctccgaccaatgtgagtcttcggatactttagaggcttgacattctctagtcctataccccccacctggccccttcacacacacttgacgtgctcctccccaccaccgtcgccacacttggagaagagtggtctgtgttgtaggtttgggaggatagccaagctagtaccggacccaacgaagatccagtccctctcctccctaacattaactagatcacagatatttgttttgtgtatccatcctagatgatagagaatctaggagccagtattttctaagtgttccaatgtggatggaacattatgatactacaaagatcagattttctctcttcctagactcccaacctcccccatactaacctcccctactcctctcccagatgaccctaagcctatcttctgggctccataattactgctgggaaatctaaatgaggactgtacagggtctctgaaaaagagagtcgtgctccaaagtgaggtcttctatctttataaataaggcagtccactacctggcccaatataaggaaaagcacagaaatggctgcacaaaatagcaaccaaaggacagtgtggtagtgcactcctttaatgacagtactaggggaggccagaagcaggctagtggatctctgtgagttggggacaatctgatatatataacgaatttgggtccagcagaactacatactgagactttgtgtcaagaaaacattctctagagcacagccatttcttgtgcttctagggtagttgaagaaagaacaatgccactcgctgttctctagtatcatccctcagagagcagccatgagcctttagcctgctgccacaaaggtgtgacagtctcttctaacgtcgaactgccccaactccagcacaccacctcactttctggccccccagacctgtgcaccaccacgcaccatgccctgtcgttcattcccccaccttaagtactccacaaggactgtttgaaagtctggtgctcattacagatccactggaaaatcgagtccagttgtgcagtgagttcttgctggctttgtaaggtaggaggtctcaatatttaatgcatccaaaggaagaacatagggcagcccacctccaaggctttaaactagatcagacattttacttgctgcttcccatagagccgcaacctaagcagcgagtgtgtttgttctaagccctctaatgaggaagcacatttagggtaggtactaccaaagtgtgctactttctagttcgtgtcccacctctctgcccatcaccatcttaccccacataaccccatagcttctgccacgagccccacctgtcatggcgctggttccagcctcatgcccacccccaccatctgtgctccttgaatactgctgggaactaacagtctgtgcctgttgatagataaagtcaagctctgggaatgccagtgtctgacacactgaaaggaagggtataagaatggctcctacagcccagccttcgctcagatactgttaagcttttccaccccagcagagagaaaagtcagactccagtttttttccatgcccttagaggataggggtataaagtacaatgacattctcttatactacagttctgcagaactccctgcctgctcctggcccatttcctcacctctaggtctcacctcccatctactggttcccaaccactgtccccttcctacaccactgcctgctgatcccacccaccctcctattctatacaagtgctggaaactggaagggtagattgggaaggacaagctccatggttggaagatctaatacctgatcagtaaaaagaagtacacaggacctactccttcatgccaatactcactagatcacagagatttccttaatacttttaccctagctgaaggaaaatgtagaggtcaatgttttcttaagacctccatggaagataggcatttaggatactacagaggtgtgtcattctctggttctacccattcccaatacccgagggtctccagattccgccccctcaacttgaccccaccccagcacgagctgtgataaaaacttgaagctctggcccaagccctcaggcctttattcacagcacccacctagacttgggtatcagctccaccaacaaggtctccctccacagaagccgaatcccggagctatgtctgaaaagcaaagccccaagacctctgaagcagaatgcagtgcaatggacttgccagaattcgaggatgaagaaaactggcttttcaaaggtaaaaacctacttacttttttatagttaccggaaagaggaaagtgactcctctgggcacgagtccagggacactgtttctttcaaattccccaggagcaaaggggaaaccatctcctgtctccccagggttttcatttctcatgccacctctcccttgatatctaagtaatatcatcctaggatccttagttttctccaaagctgtcaaactaaaccagagattccctttaactggaggcaaccagaatgacacagacggttgcgaatgaattaaatcagtgttagttaaccatgtggacctggaggtggtagactgttggaaaggattgtcttttatagattagaatgttccagtatgagcctgcagttaccatcttctttctacgttctcctcgaatgtgggttatctggtattgctcctaaatcaaactgaaggacctactcaagaacaacaaaaaacttataaactaagacatttaacatatacgttggattcattttcagggctcccaatagaggagctagagaaagtacccaaggagctaaagggatctgcaaccctataggtggaacaacaatatgaactaaccagtaccccccagagctcgtgactctagctgcatatgtatcaaaggatggcctagtcggccatcactggaaagagaggcccattggacaggcaaactttatatgccccagtacacgggaacgccagggccaaaaagggggagtgggtgggtaggggagtgggggggggagggtatgggggacttttgggatagcattggaaatgtaattgaggaaaatatgtaataaaaaatatataaaaaaaaataaaagaaagtacgcgggaagccgggcagtggaggtgcgtgcccttaatctcagtactcaggaggcagaggcaggtggatctctaaattcaaggccatcttggtctacagagtgagttccaagagagccaggactacacagagaaactctgcattgagaaaaacaaaacaaaacaagaaacagaaagtgagctagatatggtagcatatacatttaatgctagccccttggaaggcataggtatggaaacctctttaactctgaggctagcctgttctacatagagaactccaggccaggtagggctatatacagtgagaccctacctccaaacaaacaaaatatcaataaagttgtttaagcttcctccataacagcccataaaatctatatattcttgctcctatacctcctaaaacatggaatacatgtgaggatattttcaaagtgctttgacttctaacacattaaacacaagttttatttgcatttgagtctgtgtatgttttaatcctcagtttgcctttttattctctcttgtttctttcgcagttctgggattccagcctgggccgtcctctgctctgggcaagtattgcaccttggaaccccacccccaacccccaccttgatatttttgcttctgttgttgttgtcattttggtttttatttatgtgttgacagtctaggtctttaaaaaccaaaaacaaaaaataaaccaaaaccaaaacccaacagttaagccttcatgggaatgaactcagcagctcgggttctctcctttagtgctggagtgggcccggtctgaagaggaactcaggtacctttttgttctgcatccccctttaagctcattttccttcacccatttcaagaacctaatgtgtttgaaaaagtgctaaataatgctgaagggatctttttccaagtttacttacaaatagtcaaaacaataaatgaaaatactatttttttggtatgtgtaaatacaaaatttaaaacactaaaaaaggtagtaaacgacaacttttatttttttttccttttatattcttgcttgtttaaagggtccaatctccaactaactattccacaggttgtaaacaaaaaaatctctgtggtatttagcttcaacaatatcattgagcaggtagcagtctcctgcacccagcagtttaagctcaagaggcctttgatcccaacccctcctttctaccaccctttgcttcctagctgcactttcacatttgatttttcatgatcacagatgatgacaccgacgatcaggcagatgagccactgaggtaagttgtgcaacactttcttcacatcagcaatggtcacctttggtgtcagcagctgatttccacccaagtgaacaagaaatacatcttgcatgaccttgccacacaatttgatgctcagcacagaaatgtacacttccatgagacatcctagagcagtagccgggaatctatgacgctccccccccccaaaaaaagaaaagagcctttagtcttcttgtggattgaaactggtaagttgctgtgagttttttaaaaaagtgttactgcagtaagactaaaaaattttctttggacttttatttcccacagtgttctgaaacccttgttatgaacatggtagatatcaatttctcttttgtactcagttttcatgggggatgttcccaaggccagaagcattctagttgctaagactagtgaatgaggcacagtgtcccagagaactgataatggaactcccagaaactctaggagaaaatgtagcctatttgtttcatgaaaacagagggtaggaacacaagcacagccacacctacttgtagaatcttggtctagactgccttgaaaagcacacattctccactgtggatgatccagggcccaaattgcaatatagttaaatcatttagggactactgttaggaacaaatctgtttctgttaaaaatattgggaatcgccgggtgatggtggtgcatgcctttaatcccagcactcaggaggcagaggcaggcagatttctgagttcgagaccagcctggtctacaaagtgagttccaggacagccagggctatacagagaaaccctgtctccaaaaaaaaaaaaaaaaaaataaaagaatattgggaatcaaaattaggctggtgattgtgacctgaacaaaaaacaaaccgggcgtggtggcgcacgcctttaatcccagcacttgggaggcagagacaggcggatttctgagttcgaggccagcctggtctacaaagtgagttccaggacagccaagaccatacagagaaaccctgtctcgaaaaaccaaaaaccaaacaaacaaacaaaaaacaagaacaaacttgataaaattccaaaactgaagcttttaaaaggaaagtgtttggggaacaaaatacatatatcaagtaagccagtagaagtgcaacaaagttatagtcaaaaaacagattcacctcactatttcagttctttaatctatacaatgaaaaggttactctaggtgacacgcttcagcttttagattttgttcaaggcatttttctgaagtaaatcatagttattcaatcatttatttggcccctgattttactttaagcaacagattagtatgtcggtttctgaattgcatgtagtctgtcattgagataaatgactctccagtgtatttattattatgacatttttctctagcgctgccgaatttcttcacctgcaagatattcttcaggaggacagagtcagcagtaccgatgatgaggacacttgccaagctgtaagttggtccaagggaagacagaaacacaccaaggtgggagctctgaaaaacacaaatgttcaaggggtggataagactctaaacatgatgcaatagatatggtactaggataatgataatgataatgataatgataatgataatgataatgataatgataatgatgtccactgaaaactgaatcacgctaagattgtatttaattgatggtcaattgtttcccagaagatcccctatagttaggagttataagagcttgtgagcagctgggtgtggtggcgcatgccctttaatcccagcactcgggaggcagaggcaggcagatttctgagttcgaggccagcctggtctacagagtgagttcccaggacagccagggctacacagagaaaccctgtctcaaaaaaacaaaaacagaaacaaacaaacaaaaaacaaaaacaaaaagagcttgtgagctagttgtacaatgtgggtgatggaaattaagctcaggccttctggaatagcagtgagaactactaagtgctctgctaactctccagcccatagtgcatccattttcgaaagcctcactttaaaagtttccaaacaaatctgggggagaggggagctcatggggctgggctgggggtggagaactaggaggactggaaggaggggaaatgcagtcagaatgttatgtatgcgagaagagctttttaaaaatccaaacaaactgataatgtgtttaattatatacccccaaaattttccttggtagtatataccatgaataaactaaagtgtaactgcacacgtagcaagtttattcttggccgaattattgaagcacagtatacagaaagagcggtgacagttctaccttattgtgtgtcattcagcttctggcgcactgtgtatttttagtatcattttctaaagtgtgtgtctgtgaaaaggtattttagcccataaaaagtgtttttaaaagccagatgtggtgccttgaatgtgtgatcctagaatgtctatggtgaggtgagaggcagagacagaatggtctggaaggttgtaggccagttagcctgaactacgcagcatggcagaaataagacttaccctgtcccagagaaggtagaaggtgagagccaatctctctctctctctctctctctctctctctgtccctctccctctttctctctctcttacacacacacacacacacacacacacactttaaaatttgaacaagacacagcatcaatacagccttgtgtgcttagacacaccgcatagagttttagcactatgccttggggtggaggttgccagcaaaaggaatgtaaatgtggaaattgtgatattagatgaacaatgtagaggatgtgtgcttaaagtttgagagctgaaaccaggtgacaaattgttcacctctctgtgcgtgtctgaaatgaccaaaaggcaattaaaatatttgcaaatttgctaatatagaatacatgaaaattgaggatttacttccaaagtaaagattctttccaagtagctgctatttgcctaccctgaagccaggacactagccctggggagctaaggtgaatgagacctagacagatataatcctctccactcctccttctttccttatttatttctgaaacaaggtctcactgtacaactcactctgtagactaggctggccctcaaactcacagagatctggttgcctctgcctcctgagggctggtgggattaaaaactgggcttcgagccctcagtcctgcctctacctcatcagtactgggactgcagatgtgtactgccacattcagatttccttttgggattttgaaagaaagaaaataaatgtgagcagtaataaaagccaattgaggattatagtcagcaaccaaagccactaaaatattctagaaccaagtcaaacttcttcagggtatctggtgctttcattaatgtgagcaatctaccattataagaacactgtacccaaggcccattttctcaaaacttatcaaggtatctacactaatgatcttgatgtgggagagaagcagtagtccataaggtacaactgtttactaagctttgtcccaactttattctcatcagttaagactatcaactctagggttaacattaagacaaaagtcctcctttgacagccaaaaattatctacttcaattttgactttcccctgtgtctttatcactccatagggatgtactgaagatgatgaaaccagtcacagtgacagagacatagacaataatgtgaaagtcatcactggcaacattaaagcaagcccctccatgtatatgtatgtattctcaattgttcttgggttatgggaaatccagggaggagaaatacaataggagttggttatccattaactgtgcttagtcttatccttggtatcagttgagaagcaacgtaggaagatgatgaagtctgtaatgacatagtgttgtagtgatctggtctgtagttccacacatcagttgcaatatgctgctgttcctttatgggatagattgtttttgtctactctgttttgtgtgtaccttttctcacagatgattttggtatgaaattatgtaggattttgtttttgtgggcctggctctcatttttgtaggaagtcagagagttcaaagagtaaaagagaccctaagtctatttgtattcatgtgactgctcttgagtacaagcaatgtcctagagaagaactttcatgctctgtcctttcagtactgtcatttgtcatgtgctagtggaggcttacatttttcttcttttttttcctttttccttttattggatattttctttatttacatttcaaatgttatatcccctttccacatctcccccccgaaaccctttatcccatcctccctcccctgcttctatgaggatgttcctccacccacccacccacccactcccaccttcccaccctcaattcccctacactggggcatctatcaagctttcataggaccaagcgcccctcctcccattgatgcatgacaaggccatcctctgcaatgtatgcagctggagccatgtgtactctttgttgatgacttagtccctgggagctcttggggttggttcatattgttcttcctgtggggttgcaaaccccttcaacttcttcagtcctttctttagctcctccattggggaccctgtgcttagtccaatagttggcttcaagcatccatctctgtatttgtcaggctctggcagggggaggctcacatttgatgtcttttttcctttaaaatggaaaaatagtcaggtaagatagtgcacacctttcattctagcacttgggaggcagaagcaggagttctaggccaacttgctccacatagtagcttccatttgcctctgcctcccagactgctggtgggataaaggctggccttgagctctccatcaccgtctctacctcaccacattgccacttccagatttctttttgagagctacgtagagcatgatttacatagtggcttctaggctggttaggactatatagtaagagcctgtctaaagaaggtgggggtagatagcctgtcttagttcaaatataaatgggtcatattttcatgtgtgtgcatgaatgattttcatgtctctctaagttgttggatttagcctattgacaattgattacactatatattctagggagatgttcactgatcagaacccacaagctgaccaagacctggaagaaactgaatcaggtatctttcttgccctttggattgttatt

SEQ ID NO: 19 - DNA, 9196 bp, Mus musculus
ccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcga

SEQ ID NO: 20 - DNA, 22845 bp, Mus musculus
cggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtgtagcaatggattataggacatttaggtcgtacaggaaaagatggcggctcaagttcttggtgcggtataacgcaaagggctttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacggatttgcttacttgttgaattcattttaattacctttagtgaattgttactttggagtccttaaagttttcaataatttttttggcagatgatactcaaattacttggcacttaaatgtactttctttcaaactcatccaccgagctactcttcaaatttttaagtcttataacacagatactgttaatgtaaagtgaacattatgactggatgtcaggagtatttgaggttctataccagttcaggctttgcttttgttgctattgttgatgctatattgactaatggttttacttgtcagcaagagccttgaattgtaatgctctgtgtcctctatcagacttactgttataatagtaatattaaggcctacatttcaactttctgtgtgttcttgcctttatggcatctagattctcctcaagactcagcaaatagtgctgctgctattgctgccccagccccaggcccagccccagcccctgccccagccccagccccagcccctgccccagccccagcccctgcccctgccccagcccctgccccagccccagccccagcccctacccctgcccctgcccctgccccacccaaccaacccaatccagtccagccctgccccagcccagtcctagccccaggcccagatactttcagacctatcccaagcccacttctacttagagaaattcgaatcttcattgattcagtgctaaaatgcagtgtccatcactcagcctataagactgagacagcccatctataccccctccatactgacttctagagtcatggaatttcacttaatgcatagaatcgtattgctaaaatgcagtgcccatcactcagcctataagactgagatagcccatctataccccctccatactgacttacagagtcatggagtttcacttaatgcatgcagtcctattgctaaaatgcagtgcccataactcagcctataagactgagatagcccatttataccccataccccctccatactgacttctagggtcatggaatttcacttaatacatagaatcgtattgctaaaatgcagtgtccatcactcagtctataagactgagatatccctatgtataccccatactccctccatactgacttccagagtcatagaatttcactttgcatacggtcctattgctaaaatgcagtgtccatcactcagtctataagactgagatatccctatgtataccccatactccctccatactgacttccagagtcatagaatttcactttgcatacggtcctattgctaaaatgcagtgcccatcactcagcctataagactgagatagcccatctataccccctccatactgacttccagagtcatggaatttcacttaatgcatgcagtcctattgctaaaatgcagtgcccatcactcagcctataagactgagatagcccatctataccccataccccctccatactgacttccagagtcatggaatttcacttaatgcatgcagtcctattgctaaaatgcagtgcccatcactcagcctataagactgagatagcccatctatacccactccatactgacttccagagtcatggaatttcacttaatgcatgcagtcctattgctaaaatgcagtgcccatcactcagcctataagactgagatagcccatctatacccactccatactgacttccagagtcatggagtttcacttaatgcatgcagtcctattgctaaaatgcagtgcccataactcagcctataagactgagatagcccatttataccccataccccctccatactgacttctagggtcatggaatttcacttaatgcatagaatcgtattgctaaaatgcagtgtccattactcagcctataagactgagatatccctatgtataccccataccccctccatactgacttccagagacatagaatttcactttgcatacggtcctattgctaaaatgcagtgcccatcactcagcctataagactgagatatccctatctataccctctaccccctccatactgacttccagagtcatggaatttcacataatgtatagatttctattgctaaaatgcagtgcccataactcagcctataagactgagatagcccatctataccccctccatactgagttccagagtcatggaatttcacttaatgcatagaatcgtattgctaaaatgcagtgcccatcactcagcctataagactgagcccatctataccccataccccctccatactgacttccagagtcatggaatttcactttgcatacagtcctactttacttgtccatggacaagtaaacaaagaactcttgtccttcatgttaatcaagatacaccaatcaaacaagagttttatatcagagacttgccatggaggtatcatctctcaagtctcctttcctttaaggaaagaaaaccattctgtcattgctgtagtagtcacagtcccaagtttctaagcagtgttcagtcgtcttttctcatgtattaccttgagtactgaataattctgtcagaaatattttgtccattggattagactttagctagtccagccctgtgtgcatttagcaaaggggcaaacacaggtctgttatcagacagttaaagtgctcagtcccaattttcaaggcattggccattaaagggggtagaatactatatactgttggcatgctgtcatgggtgctatcgccccaggtcacatctttctaactgatggagatacatttatttgctcatgatattgtatactagtctcacatgctttcttatttcagccaaaaacctctgcactggaacattttatgtggataatcctgactaggaattgagtcttttctcaaggtcctaatactacccttgctttatgtaaagagggtgctgattacttaatgcctcttacacaattgtgcaaaattgcagttgttcaagtccccttctgttagtaaccaagatcccataccctcataccctaatgggtgacaatcaagggtgccaaccaatgagaccacttctctgttctggtctttctgctgtgctggggaatcaaaccttgagtcttgtgtacgctagtaaagcactgtcatagagctacagccccaccgtgtggtggtttgagagaacagcctcttatgtagcctgggctgggcgggacttacaggcattgccacctgtaatgtaaacatatttgtgcctgttgtgtgcacagctgcatttgtccctcttcctaagcattggataaagaaaccaaactaagtcaagtcattttgttggtaatcaagaagacctttgatctgtcctgtttttaacttccaggctggcctggaacttagcatataacccaggctagccttgagctcaggatctagcctgcgtttaacaagtgttggcatatctggttcctaccactatgccctgcatgcagtctttcatattgtgaatgtgcatatgtcatttcactgtagtaatctgcatctggtgaagacttatttgtattgcagcagtatttaagatccttaacatagtaaatgtgcacagtgttaactctattgtacatattctcatgtccacagttgtgccttttagatcaggactcctgtacttagcaaagcaaagaggctcactaatataaagcttctttcatgagactatagattgaaacgattccaatacggtcaatggtccttcaaggtaagacttctgtctctgatcattcatatcctctttgctttatggaattatgtatgtgctgtgcacttgaaaccccttcctcaaactatttatgtacatactggcaattttagtaggatcaattttactcttaactttgaagtacagaagtggtgttgacctataaggtcccattttgtggcttgctaataataatgactgattgtagtaggccttttctgttcactacagaaggaaacctgaacagcgtaaaactgtaatggccataaacatgtaccttgcatattagtatgcatttactgcacacatctcattccatttggatacgatcctactctcaaacccttttgcagtacagcaagggtcactaatcttttggcttcttcatcttcctggacactggataaggctgtcccctcctttccactctttaatttccaggactattactttaaagacttaatatttgcataaaggatggggtttttaattgataacatgtcccttgaacattaatgtatataacagggacatgatccattcattttaataaaaatacttggccagttaatgtgtaaaattacacttatccacaaccttattacttttcggaccattgtatctcttgcactcctgcaagggataccgtttatctcccaaggtccctgctagtggaccattaatatacagtgaatcttcctttgtctttgccagtaaacaaaggccatactccttcgcctttcatttgcactatatcaggatatgctgatcaacaaggccgcattcttttggactgttatcatatattaaatgtatgcgtatgcactgccacctgctctgtgcacttgaaaggatcccactcacttccttagcaccttcagcaggaagtgataataagctcaagactttcatttggaaagttcacatgtctaagcacttctctaagaactactgtaccctcttctccgctttaaagcagaaagagggttgtacgaagtgctcttcatttggacttaagtgcattaatgcagttagttgtccatcattacctttggagttggattttacatccttgtactcttttgacaccagaggcatattaattatttctgagcacttctcttgtcaatattaatctgtacccttacacatatgacctgtgcggcagcaaaggttctgaaatgcctaccttttgactggggctgctgagtggtagtaactattagtaacctcagcatttggatgattactatgcaaaaatgtcaaggacctgtgtgctctctttgcataccatcaaggctactgagtcccagaattaattgctaagttatgcgtatttataactatgaatgtctggaatattttgtcccctttacattattgcagaggttgctgagcccccgaaactacccggtactgtcaatgagcacaggggctctgacgaatgacctgctctcttccttaaactgattttgggactcttaataggcacaatggcagttctggatggtttattttctactccaacttgagcaaatcccctgctagtttcccaatgatataataaagtacagcagtatgtacacccaacaatgacccggatttcgaccctttttgcattgctttaatatatacaatcctaaatagtcacaatctcacactttatagtgttccttttgcccggcctctagtttgtccattgaccacttttctgaatcactaattctcacaaacccatcattaaggaagagtttgtgccctttctcaattccatcatgccatcccttttgcctctttgtttgaacagtattgactgggcaaagcccttctcttgacttaaagtcaacaacaccagtttactcacttcatatggctacagtgtctcagttgccttctccttgctcccactgaacagagacacctcgaattcttacattattctgggtaatgttaattaccccaaacaccctatgtgtcattaataaattttggtgtatttatacactgaatagcaaaagcaggccaaaactaggtggatgagccttcaatctttaacttgcacttctaaattattccaattccaactgctggcacattctagggccaggaaccattcttgcctacctttattaatgctttattgtgcaaaatattgcaggcaagtagctcagggagttggattgccaccttttacttggggctttcctttacagtatgaactgaaaattgtcttcctgagaaggaagcttagcacttttctttccattcttcctccaggaaggagccaactgtctgcttaagaaactttaagcccgattttgtatattgctactgtacaggaccaactgccagaaaagttattgataattttattccttaagaaaggcatttggattgcaaggtggattgactgtgagatcattagcttttgtgaagtaaaaatagccatttgtgtcatgtttctgaagactaagcagtgtctcagtgtactgagggtgatgagtctgtggaaagatcagtgcaactattgcagaatgtttaagacaagtatctttgcttggtctttactacaagtttaacaaaacgaaaaagtcaatctttgtgtggcctttagtatgattaactttttggaagatgacctaagccttctaatcattatattttgtctgacattggtcaccagtccttgcttatttttaaaaggtgactggatggattaaatttgagaacatgtcaagtcgcctttgaaaattatataggccatcacatttaattaattcattctatccaccattaaactctggcaataatttgaagtagcttgaaaattcctaaagtgggaatttattttagagatgatagaacctgtttccccactttacattttaaaatatgtctgccaggatctaatcattcctttaaacgtacacttcaaagagagattttcctagtaagaaaagagctttctctagtgtgaagggtgctttgtagccgccgagtacttaggtcttttttgggagctattgtgtatgagtgtatgtatgtgtgtgtgtacatgcatgttgctgcgcgcagtcattcattcacatggtgctcagacaacaatgggagctggttcgtctatcttgtgggtcctggagatcaaagtgagatcatcaggcttggcagcaagtgcctttaccctccgcgtgccatcttgccatcccgctgctgagtgtttgatatgacattgctgatgaaaataatcatcacaacagcagttctcccagcattactgagaaatgatactatttttctgaggaggatgttcaagtaactcatccagtgcaggatcctgcttgaactactgctcctccgttacatcagactctggctgtttagactacagtaagtactaccttgttagctactaagctatctttttctcattcgagtttctttctgtgccacccactgaaaagtcaaagtgactaataagtcactagctcttctcagcttatccatacacaacacatagtatgccaacgaaattgtagaattaacacattgtgtacccaatcgccattatgctggggtacactaaaatgagaagcgatgatattttacaaaatttcttccgtgagatgattatgttatttaagacttaatgtaatataagcacacttgagatcattttaggaaatgtactgcctgtgtgaattgtttaagtattttaggaagtctactggggttgaaatttgacttcttaaagagggaagtgtgcttactttgccttgttggtccagacgactattagtaccatctggttggtttatctgaatgccatctgtttctatctacctcttggaagcatggaaagaatattaagagtgaaagactccatgcattatgcttagctgtacgccaagggtagcaagagatgagcttgtgtaggaattgggaatataaatttgataatttggttctttcaaccatttttactgcatttctgcccagaacagaccactggacggcactaacagcttagacagagaacttcatagcttacaatctttttttttttttttttttttttttttttttttacaaaagtgcaaagaaggataagttttatgaacaaattttactatggactactttatgtaccctccttgctcatttttctttttcattaattaatcaattaattttgttttgttctctgttttgttttgtgacagggattctctgtgtagtctggctatcctggaactcaaactcaagagatccgcccgcagagatccgcccgcctctgcctccagtttagagtgttgggattaagggtgggtgccacactggacccctgccagcacttttcaacagatactttcagttaaaacaacaaatacttgactcctgtgtagaaaatggtctagctgaaaaaacatccttgtccataacacttaacatttttttgcatttgccttttgtacgtgcaaatgaccctctagtactttaacccttttaagtccactgtaaattccttcgcagcaggtttcccccaactccaaaggcttagcattgtctggctctctaggtgataatacatctagaactattgagtcttttaggaaactaggaccattgttgtacaagtaactgcttcaaaaggaaacatttgcaaggaaaaaaagctttttgagatgctaaagaatgtgtttggtgcactaagacagttagctaaagcttcggtctcaccttagcaccattggctacccaccccagtacatgcaaagtgaccccccccccaggcttgcctaggcacctagagctttcagcctgcctcctatggacctaaatagagattaggactcagactccagttagtggcctggaggaagctggtactgctgctattcacagtaaacccactatcactgacagttccctattgaaatgatcaagttgtgtgagcaggcagatcattaatcagggccaattctgtcatggcaacctagtcctacatgacctccacggcactgtaaaatacacacttatttgtagtaggacatctggaacatgagcttgtctgtgattgaaatgtccattaggaggtgccatcacacaaaaccatctggaggccatctttggtccccataattgatggaatacaaagagttccccaaattagtgtcctgacccagccctcactgtcagtaatcatgtaatggaaagccaccaactcgccatcaccatcttcaggctgcctgaactgtatacattaagaatgagctttcagccgggcagtggtagctcgagcctttaatcccagcacttgggaggcagaggcaggcggatctctgagttcgaggccagcctggtctacagagtgagttccaggacagccagggctacacagagaaaccctgtcttgaaaaaaaaagaagaatgagctttcttccaagctgtccaatggcttgacccagacttaggagtttgtaaacaaagaaccctgtagaacaagtgaatttgagaatgtacaccttcattaagtggtgggaagtggaagtagtggattttgccagctgattttacaaagccctgtggcagaaccagaccaggtctttgtatgcatactgccatataacctagccactgtccaacctgtgccctctctcccagtccagtgaacctcttctgcctgccccttacttagtcctctggctcatcccaggggaagatggctctatttgtgtagtcataagaaagttttgttaattttaaataaaacaggaaaagagaaagctcacttaagacgagagctggagagatggttctgttagtcttccagaggtcctgagtacaattcccagcaaccacatggtggctcacaaccatctgtaatgacgtctgactccctcttctggcacacaggcatacatgcagatagagtactcaaatatacaaaaagggaaaagaaatgaaaggcctttgaaatgtagacatgctttcaattttaaaggctgttttcacatctcttaagaactaggggttccatgagaacatatcctcaccctgagttcttaccaccaattgaaaacgctgacatgtgcatatgaagattgtattgctagtaatcaaattatcatttgtagagtttagtataattatcatttgttttccagggatgaatttggagtctgttttgtgctcctgcctcaagaagaaggattgcctggatttagaggagtgaagagtgctggagagagcccaaaggtatttccgttacttggttgactgagatagtatcttcccttaaaggtctaatgtgtcaagttatacctcctaagtaaatacctcattattttcatgtggaattttcaacaatttttgtagtctaatgatagccttgtatttcttcacagggacaaacaatccctatgtgagactcaaggactgccagcagcctatacagctacattacatctcagcagaacttctcttcaagtcctcgctactctgaacaaaaagcttacaggccacatggagaaaaaaaggtactttggagaatttgctatttgggggtttctatctgatctccagttcatcagagaatgagggggcaagtcaataaagcactccccatctcctggtcccctggcatagtcagttagccaatgagatccttgccttatgatgaggccttgaaatcatccccaccatgttatgaccaatctgtaacatttctgctctgaaatgcctaaaaggtaggttatcagaggaatgaaggccagtttctgacaccctagtcttttgtacttgatagagtaagtagatatggctgttgtcacattctgtaggcctgtcataattctggtctctgaatatcctcaaactcagaggtccaatgctacaccagtttctagggacatatgcaccataagcactgagccaaacaatgctattcaccttgccagtgttctggcatggtattgtttaaagcacaaattaaaagaagaaaataatttaacccctttattcccagagtatttgaagtacaaggactttaacacaacctataatctaaaggatctctcattggtaggtgacagaataaaagccagaaagaacttggatggagcaattctcatgtctctaagttaacactaagatctacaaatgtgaagggttcactctccaagcccctccccatgatttaacacaactgctggttactacataatgagacaactttcccagtattcttgatttcaagaattggcttttctttcacctcttttccagatctccccccagaattgtgggcttgctgctttgcagtgctggcgacctattccctttgacgatccctaggtggagatggggcatgaggatcctccaggggaatagctcaccaccactgggcaacaggcctagcccagatttcagtgagacgctttcctgaacccagcaaggaagacaaaggctcaaagaatgccaccctacatcaaagtaggtaagttttctgcaacagtgtaataattttaactttgatcttgttttccattaaagtcagccttttacttgagatatatacataaattttatctttttcccacatctgggaaatgtaactaaacagtgcaaatgtttcttctaggagaaaagctgctgcaatagtggcactgaccttcgaggaagccattctgctctatttggttctctctccagaagctaggaaagctttgccagctgtttacatacttcaagatgcactgctaccctactcatgccatataatacacaagtgagtagcttatttacctacctagctatttacgagtacactgttgctgtcctcagacacaccagaagagagcaccagatctcattacagatggttgtgcgccaccatgtggttgctggggattgaactcaggacctctggaagagcaataggtgctcttaaccactgagccatcactaacattactgatgatgaatgcctctaactacaaatggaaacctggctggaattgatacagaagtatctatcattaggcagaatttaaagagccaggatgttctagtacttctttcctggcattcatacagcttcttttgttctttgtagtgccatctaccaaatattacccttccccaaagcagcacagaaaactgggtcttcagcgtgatcaagcaatgtgaacacacaaaaggaaggcagctttataaatgacccgaggatcaacatgcctgactgcagcatcttaaaagcaatagaatgaggtaagtcactagcattgcagtcttctgaggatttgcatttgctggaagatggtgctgggtggagagcatctaatgtgataatgtgaggcagggccatgtacacgatggaagatgaacaggctttcacgttatcaaatggcctcacagcagcaactcaaactattatctgcttaccagttatatcacaagaggaatttagcttctaggttttgttgttgttgttgtttgttttggcttggtgccctaccattcttacagacttaaacattgaaaagctttaaatagtttatttcttatctccatctgtgaagcagccattagacttgtgaaggatgtaaaaaccaagcccccccttttttttaatagaagaggagagtgaagctgacaattaaatatgcagtcgcttatagtgtttgctgcttacagaagcttttaatccatgtaacagaatgttgagatgttcattctgtgtttaaatgtaatattccctagatgtatgccctttggcaatttagttctgctaagacctgtctgtttgtgaaggtcaaatgaaatcatgaatggaaagtgttgagtacagagcctggcaaatatgccctggagttgcatgactaggccatttggaagagttgacgggtgtgtcctatggtcctatgttaaggaaaccttaagtttaacgttgatagcctggtacagtgtactaatggcaatttttttctttgcccttccctgtttcttgttaccctctttctggtggtctttgcttactatcaatcattagtgtgtattgtgggtgtgtctatttcttgttttatgtatctattttttccttggtctgtgtgtctaattctttgttacatctatttcttccttgctttgtgtgtctatttcttccttgctttgtgtgtctatttcttccttgcattatgtctaattctttgttatatctatttcttccttgctttgtgtctatttcttccttgcagttgtgtctaattctttgttacatctatttcttccttgctttgtgtgtctatttcttccttgcattgtgtctaattctttgttatatctatttcttccttgctttgtgtgtctgtcttccttgctttgtgtctatttcttccttgcagttgtgtctaattctttgttacatctatttcttccttgcttttgtgtgtctttctttcttgcttttgtgtgtctatttcttccttgcagttgtgtctaattctttgttacatctatttcttccttgcttttgtgtgtctatttcttccttgcattgtgtctaattctttggtatatatatttcttcattgctttgtgtgtctatgtctccttgtgttgtctaattcgttgttgcatctatttcttccttgctttgtgtgtctatttcttccttgctttgtgtgtctatgtcttccttgctttgtgtgtctatgtcttccttgttttgtgtatctacttcttccttgtgtgtctaattctttgttacatctatttcttccttcctttgcatgtctccttctttcctttgtgtgtcttttctgtctgcagtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgcagtcacaccttgagactacagctctcactttagctgggaaaaacatcaaggtgtagaggaggcaagttaaataaaaagttgctcccctcctcatgggcatgcttggtagagtggaaataataaaagaggttctctatttcctcggttccacacattgcagaagatgctactggatgctaagtgcaacacatttgttccaaaagggcactcagtgtgacttacagatgccccggaaagcagagggatgctctttattaaacagaaatattagctcaaacgttttctagactgaagaacactttcctcatttcccacagtttgcctcagaggttgaatacaggaaggttattattcattcatttgctttattggttcgcctgttctacaaggatttgcatgtctcttaggccttcacttggctcctgagacatggaaaaaggaaacatagacatagggaagtgctggatggggggggggggtctcttttctgggtagtggcacgacttagtccttagtccccaagtaatatgcaatgtgagtcctcatcctcatgtcttctccggccactgcaatgagtgggaagctgggctttgtagcaagcctgaccctaaagttacagaagccctccacgctaagaaactcaattttctaggccattttagctatgactgtgaccactactggtcaggagggatgacagccatctaagttccacaatcttaggctactttgcattatcctggggcaaacaagccatttttgagctgcagcaggctttgaaatacattgaccaattttgcctgtgttcgttaaaccttttacctttttacatgctaatgctcacagtaatttagaaatgttctccttactataatatactcaaggtggcttgctatggtaaaataatgccagtggatgaaaataacattaatgtttaacattcttgcataaaatttaagaataataaaattgacaacaatcagaaaactggaggaacgaaagaccaaattgaaagaacttgaaaaagattaaaaatgcctgtgctttgaccctttccatttttctttcactcacagagggtgggacaggaggccgagtgaaggaaagggtccagcctgtctatctggaatctaagttgggactttaatgcagttccacaaaattggtattaattcgctaaatgtttctgaaaatgtattttcatctaaatggctatcagctaagccttgagtcaaatgggaatgaaacagattaagtcaatgtgatctctttatccaagttgccttagagctgaagtcacaatttgctgtaaggaagcttattcattgtagcatacgcatactttcaaagtatctagactttacttagtaacccaatcaggacattcaggcaaaagaaaaggaacagagaagatggagccaggttgaagaggtctgggagttcaaacaaatttttttcattttcattaaaactcaattgggcatcaaaagtgttactaatattagcttttaattagtggaaattggctggattcagtaatatccctttgtatgggtaggaatgggcttacatttctggaatttgcaaaggaaaaaataactgaaagccttcctttcacagttactgccatcaatattgctaccaattaagcacatcctaccatcatctgctttgatcacataaatgaactgtgtaccaatctgttgttgaaagactggagtcatcttcccaccaactgtgaaaaaacacatggaaaacacctggactttgtgaacggatgcggaatacagaacttctgttgactcttgggtgttttgaagacttgaaaaaaaaaactgttgcttaccaacatgtcacaatgagtccgtgtgtgggtgggtggatgggtgggtgggtgggtgggtgggtggttgagtgggtggggtagtttgctgttaaataaaatgctttgttttgaa

SEQ ID NO: 21 - DNA, 1693 bp, Mus musculus
cagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaaga

SEQ ID NO: 22 - DNA, 2408 bp, Mus musculus
ccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagca

SEQ ID NO: 23 - DNA, 222 bp, Mus musculus
atgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcac

SEQ ID NO: 24 - DNA, 1871 bp, Mus musculus
ttttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatct

SEQ ID NO: 25 - DNA, 1224 bp, Mus musculus
aaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaatttt

SEQ ID NO: 26 - DNA, 1224 bp, Mus musculus; identical to SEQ ID NO: 25

SEQ ID NO: 27 - DNA, 2483 bp, Mus musculus
aagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaat

SEQ ID NO: 28 - DNA, 34 bp, Mus musculus; identical to SEQ ID NO: 13
  misc_feature (6)..(7): n is a, c, g, or t

SEQ ID NO: 29 - DNA, 32 bp, Mus musculus
  misc_feature (1)..(4): n is a, c, g, or t
  misc_feature (6)..(8): n is a, c, g, or t
  misc_feature (10)..(10): n is a, c, g, or t
  misc_feature (12)..(20): n is a, c, g, or t
  misc_feature (24)..(25): n is a, c, g, or t
nnnntnnntncnnnnnnnnngcanncatttta

SEQ ID NO: 30 - DNA, 30 bp, Mus musculus
caagcacttagccaycgcyccactgtcccg

SEQ ID NO: 31 - DNA, 32 bp, Rattus norgevicus
  misc_feature (1)..(2): n is a, c, g, or t
  misc_feature (7)..(8): n is a, c, g, or t
  misc_feature (11)..(17): n is a, c, g, or t
  misc_feature (19)..(21): n is a, c, g, or t
  misc_feature (25)..(26): n is a, c, g, or t
nnyayannycnnnnnnnynnncagnnatttta

SEQ ID NO: 32 - DNA, 31 bp, Rattus norgevicus
  misc_feature (8)..(8): n is a, c, g, or t
  misc_feature (20)..(20): n is a, c, g, or t
cargcacntyagccacctcnccactgwcccg

SEQ ID NO: 33 - DNA, 252150 bp, Mus musculus
  misc_feature (222949)..(223540): n is a, c, g, or t
  misc_feature (242091)..(242091): n is a, c, g, or t
agacctccgattaatccaacacagttggggttaggggtagcaaaaagaagggcacgaatgttttagagggtctgtcttttcttttccttcacctcttgcctttcttttcttttcattttgttttctatttctctttctaaggcctctttgtatgtctctgactggcctggaacttactccctaactcctgctggcctctacctctcaatcattctcaccctgctctctgggagctgggattataaatggatggcactgtgcacaccttcagtggctgtggcttaacaagttgtcagaaaacaaaagaggattcttttaatatccaattctttaaactgtgttcctacctggggactgttgtgctttctttagctgtttagctttgggttttttgttttttattttttggagattgagtcttcctctataactcaggataatccagctgcttctgacgcctgagtgttgggattacagacatgagccactcggagctcttgttattcttcttaccatggatttctagaagaagctcaataatactatataataatataaaatgtatggttttggccctcctgccatagggaggtaatggtaactgagataatgtagttccaggagtaaggggagctgggtatggtagcatcacttaggaatggtagtttggactggagacactctaggaaatagaatggcagaagttccggttgatgctatggcctgtgccgttaatatattacgtagcccagccaccttgtctctgtgcttagtgtgtgttgtatgtcttctgttaggtaccagatttgcttttgctttttctagttcatatgtttgggtagcttttgtatggcttcctctttcccttaagttttgcttgcttatgctttcctattcgtttcagctctcaaagcctcatcttcgcattgcgtgttggctttccatgtatctttctcctttacctccctttaatgagtcctgtgaataacccatctccagtaactgagaattcattgctagacctgtcctgttccaggttacagtgaatagtctgtagatctttggtgttacgctttttgcttaatatgacgctgcctgtgcttttactctgtttatttctaatgtacagttaacaactgacttcttccatcctctgtttcaggggtttcatttgcaaatgcctgcaggatccagatgggggacatgtgtgagatggctcctggtattcattctctctctctttctctctctctctctctctctctctctctctctctctctctcaaagctgggttttgtggtgttttttctttatcagagagattaccggatgccaagggacagatggtggatctaagaggatgggagagtatttgaggccccgacccatttaatgtgcaaaatgcatctaaagagaaaggctagtgggctggtgagatggctcagtgggttagagcacccgactgctcttccgaaggtccagagttcaaatcccagcaaccacatggtggctcacaaccatccgtaacaagatctgactccctcttctggagtgtctgaagacagctacagtgtacttacatataataaataaataaatctttaaaaaaaaaaaaaaaaaaaaaaagagaaaggctagtacttggctgctgctaattgtctggagacgtgcatccaggattgccagggcttctgattcgctccaagggaaacttgagtagcttcaaggtttttgttgctttttatgcctcacagtagaagactgtgttcataaatgctttaatagtcttatagtctctgtctatttgcagttgtattactgtgatgttaactgtgttctgttaaccaagggtatgtggaacacttcctactgcactcagatgagcccttggaggtttcctttgggcagagtttagaactggaccacaatgtgcttacatctgtgtaaattaggataaaatctaggaaaaatagatttttatacatacagaaaaacagagaaacagtagcaaagaagaaaagctggtttatttgtttgccgttggggagctggttccagctcagctagcttgggtgataaccatttgccatcatgcctggcaaaatcttgggctttttggttttgttttttaatgttcttctgaaaaatcaaataataggtctaaatttccacagagaaattgtttcaattagtagagcatttggccactatgtttttccttggatcaatccagcacactgcgggatgcagggtaagcaagaaaagatacatcttacaggctgtttccactgggtccaagctgtagcacggctattttaaaaggacatttaaaatttaccacattgtatgctaagatgttttgctgtttatgttacttcccccgctacttggggcttttaacattttctttggcgtgcgtgcatgcgtgtgtgtgtgtgtgtgtgtgtgtgtgtgtgtgtgtgtgtgtgtgtttgtgtgtgtgtgtttccctgtgtggagtgttattgatgaccagttgtcttcctcagataattaacaacttatatatggaagcagattctctcagtgagacagcttgctctggggggtgcctgtttccagcttttaagcacagggattgcaagtgggctgtcatgtccacacttgctggcattcagcttgtgctgggcatcctaacctggcttcttaaatgttaccagtagatacatagctaactgagccctctcttgagcctcaagttgccagcatcctccatttattttgtagaaaggagagaaggatggggaggttaagaacgtgcacatggagccggtcgtggtggtgcacgcctttaatcccagcacccgggaggtggaggcaggcagatctctgagtttgaggccagcctggtctcagagtgagttcctggacagccagggctgcatggagaaaccctgtctcgaaaaaaacagaaagagagagagagagagagagagagagagagagagagagagagagagagagagagagagaaagaaagaaagaaagaaagaaagaaagaaagaaagaacacgcacatgggagaatgcttgttctgtgtgcatgtgtgtagggcagcagcaggctcctggatatcagaggacagcatctagagtctgttctgtctaccacctatgtccttgtggttgaactccagatatccgcattatggctggtgcatttaccttctgagccatgatactgcgacccaagtttgttgttttcagggtgtttttttgtcccctcttgtggtgctaggaatagaacccaggaccatgtactaagtgagggctatgcaaaaccattctactattgaccgagctacatgcattgagcaccactgggaattctaggtaattctatctttgagccgtagccattaagtttcctttggtggcttttatgttactgcctcagccattggcgtagctggaattatgggcctacactatcagtccacttcccagtcttttttattgaaaacaagctaggctcaagttgtgtacctcaggctggcgtagaccacaatcatgctgcttcatcatccagaaaaagaggattacaggtttgccaaggctggatcaattaagtaattttattttttaattttttaaatgaactctcttaaaagatttatttattttatgtttgtatgctgtagctgtcttcagacacaccagaagagggcattggatcccattacagatggttgtgagccaccatgtggttgctagaaattgaactcaggacctctggaagagcagtcaatgctcttaacctctgagccatttctccagcccaattcagtaatttaaaatgcatgctattttacaagagtttaactagaagttgactatcagttgtctcacagatagtaaaggatagggaagtttgagaagttcatcaattctttaccctccctcaaaaagggaggccataactaagtccattgtatgcagtcagtgatttggggctcagtgtcttcagaagatttctaagttgccatggtgttgaagtctcctaatagtgagcctaaactgttttaactgcattttgccttgagcttttcactttacttagtgtctagttgttctttagaatgcacccaagtcctgatttgtctttgtaattaactctgatagggtatttctctggctgcatccctctgaatagttgatcctcacaccccccccccccaaccgccatgtggcaggtaaagatgtcccagtggctggcagcagggagacatctatccacttagagaatgctgtgccagtaaagctggcgtcttgaatttcagggtgagcctggagaagcaaagttactaagcttgttaagtatgaagtatttaaactcggagacgtagggaaagcacggggacaatacacaatttcaaggcttcctgagagctgagattaaatgtatgtataatgtctacctagatggttccttggctttttgtttgtatgatttattgattaattttggtttttcaagacagggtttctctgtgtcctggaactcactcccaaaaaagggaaggatagaagaaagattataaaatgtacatatattgatggaaattttgtcatagctgtgagattccttccagtggtctagcaaaggtacctcagaataagattcataatgaaattgaaattctttgggcttgtggatagtttcatagtcttaaggaaaggatgtctgtagatacctccattcctaccaggcctttggataatatggggtcctgctgatcttaatcttagtcctggttctgctgggtggctctgaaagccttatcagtccttggattgcttaacagtcaggtgactggagggactgctgactcatcgacttgctgtcttcaagtgaccttcaggattgtaggataaaagacctgaggcagacttttaggcacctctctggggtctggcacagtgcattgtaaaaggtgacaatgaaattccttaggtttatctttgtgctttcagccctgatgataagatagcttaggcatctgcagtttttagattgataaaccttgaataattaacttcaggcatctgatccaaaagaagtaaccaaaactaaaggcagatgttctaggctttcgtccttggtttagtgaccttgtaggcccaggtaaggagagaagtgaccttgtagacccaggtagggagaggagccatggctttttagcaaaagaaattctaagtgattgttattaaaacaacaggagaaacaacgtatggtcttccattagactacatatattagaagttattttgcattggtaaacatttagctaagcagacatacacactcataaataaaaataaaattttttgccaggcagtggtggcacatgcctttaatcccagcgcttgggaggcagaggcaggcggatttctgagttcgaggccagcctggcctacagagtgagttccagggcagccaggactatacagagaaaccctgtctcaaaaaaaaaacaaaaaacaaaacaaaaaaaaagagtctcagagagatctcagtgggattctatttgttgataaaaaacaaaacaaaacaaaaccaattaaataactaaaatgaaaaatttttgtaagaaaaggtatgtgactatcttagtatatctgagttcaactatctgacttaatgcatgtgtttgtttatgtattttattagtatagtctgttgtttgtgtttttttagacaggtcctaatcttaatgtacacctttttaccttgaattaaaacatagccaaggatggtctcgactcttagctttgtgcagtttttacaaatttctgatacactgctgttctaagaagtacttttattgtttaatcttaggtgtctcctatgtattcctaattgacctgaaactaactaacctggcctgaaactcacagcaaatctcctgttcccacctcctgcgtcctcagtcgacatgtgtgcaccaccatgtccttcactaacattgttttagtttatagtgcagtcatttcttatccactctcttacctgggatattgtccacagaacaacacttgccataataaacagggtcatcattttctaaatattagcatatattagtttttttttaagtatggtgtatttgtgacactcaggttttttagtatagttcatttgtgacatttttgtaggcttaaatctttcttacatcgttgtaattatgcaatattttccttttgtgtccagcatactttacttaacatagtatccttcatgttcatgcatcatgtatatttgagaagtatttcattgtatggacatgaattttgcttggccattcatgttgttcctataactctttatatggctacattttgttcttgtgctatgtgtacatagagctactctgaagcatgcttgttgcttttagctataggaaggaattctatcaggacaggattctttacatcttacaataaaatccttcaaattcacttaaatatgaagatacgggattgggctacgtatgcagttggtcctccacttcacaaatatgcttttcctttttctgtaaatatgcttttattttatgcacaaatatgcttttcctcttctgtaaaattccagctgagcctctgtatttgctttttgaaaaaatttgctattgaggattatataaaatcatttcaatttagcacgcagaaattataaagttataaagtatatatgctgatttctgtaaatttgacagaagttttagaacattagggtgggggaaagggtctcattatgtagttctggtgccctagaactcactgtgtagtcaagctggcctccaactcatagagatacgcctgcttctgcctctgaagtgctcagactaaaggtgtatgccagtatgtcagcccaactttaagatagttattaaaggcatataaagaagtctaattttatccctaaatttagttatttaaacatgttcaggtacctgtacagatgagaagcggtgaactactatgtggaaatgagtccaggtcatttacttagtcatagtaaagctggaaataataggaaggtctttggaatggttagagatattagtaaaagaaaaatggaaaagtctattacgtgctgttaagattttgtgcagtacctgtctagtaaaaacctgaatatgcctcataaagtcgggcagactcaacaaaacctcatgaggacttggggcaacaaccctagggagtacagactcttagaaagataattgtactatctggttaaaggactaattattactcctatcactttagtgtggctcaaggtaagcccaccttcctgagtgattgtcccttggccaagcacatgactcagcccaactggattaatttgtaagggaggagacaatggcatgcctgcacccagaggtaaattccattctttctgctggtagataacagacttccgtaatgtgccttgaatactaccgctgaaacatttctgctactatttccattatacgttatagacaagtcatccaacgagtgaagttcaaactttgctcaaagagtaccttctctgaatctaatcatacagcagcctgccatgctagtgctttgctatattttctagtattgtctttgtaacttcattgatagtcttgatatttttttggtatttttatcccccatgatcagtctttcctgataacttacagtctaccacacttaaaaatggtactccttcgaggccaccctggtctacaaagtgagttccaggacagccagggctatacagagaaaccctgtctcaaaaaacaaaaacaaaacaaaacaaacaaacaaaaaaatggtactcttttcaaagcagtatattgattccgaaatagagagctctcctttggaaggagccaagcatttccagagaacagtttgttttcttatacattggaacaattagaattgtttgtgtgtaggggacatgtacattggggtcagaggataagttgatagttctctccaccaaactgggtcaaacttggcaggatgcatctttatcccatgagcaatcttaccagcccagtattgtaaaataatataaccatcccttagtttctgactccagggcccctacccctagtgttacagctttcatgaacaagaaagccttgctccttgctttttggctagatcacctcccaactttttcttttccgggattgcctttggtccattacagaactaagaagacaaaaaaggttcttgtggggcaagtgctgtcagtcaggccctgcattgcctggtctctttagtgctctctagctctaggttttcaacctccctttaactattttgggttctgtctttccctatggtggtgggtctcagcctgtgagtcttgaccccttagcaattgtctacgaccattgcagacacaaatgtctacaataaatgtataaccatagcaaaattacacgcatgaagtaccaatgagaatagttttatggttgggggtcaccacaacatgaagaaccgtcttaaagggtcttagcattgggaaggctgagaaccactgctctatggaaacttatggaagttactctgccccaaaagtcacttggattaaccctggccccttagccattccaaatatgagacttgtgatcatttttactctgccatttgatctttttaatgtgctctcacaggacaacttgagcagaatctaagagattcctttaattacaaggtgcaaatgtctgcttggcattagatttgctgtctctttggaaggtgtgccgcatctttagaaaatctgtatcctttatgcctgctgctacccccagaatcttaagacaagggtaagttgtttgagataaggagtgcagatccttacattaaaggttcactgagtaggccctgctgagttttatgtgtaagcattagaacgttttaatcagtctcctttccttctgtaggctggtgggctgactcaaactaaaggaaactgcatgaccccctccagcattttaatagcttggcttgtcatctattaaggagcaaatggaaatcgtaggagtgtaataggaaatgttatggatacgggtgatacaagtatatgtgttgctttaggacaagaaggaaagaacatctttccttttagatcagcctgactggttgattttttttttaacattgcatagtgctttcaagagctaacattccaggaagcatgtattgtaagtaggtaaaaacaccagttctgctccagtttgttgacaaggcataatcctttatctgccccccagctcactctaattctgatttctcctattttggaatttattgtatgtccagtgtatttcaaggcggaatttaagggctgtaagagaacccactcatttaggacccctgaacaatgttgcaaaatatggttttctgtggcctaatgctatgcgatcaaggggctatcaaccaacaatggggtagcgtgggagaaagaaatgatttttttaagccaggttgtctgtgtgtagctttggctctcctcaaattcacaagcttctgccttgctgtgcctcctaagtctgcctcgtgagtgttgaggtgtgtgccaccacacctaacttcaaacattctcttaacatgaataggaaaaaggttttgtaacacaagttgcccagcttatcaggtgtgtttgaaaatgtgataggtcagctctccagccactggagtaattgataacaatgactgtcgctaagcagaaatgggcagtttttctgtttctttagcttggagcctgttcagcacgctcatggaccctcatctttctatcatccccttctcttttggagattcaactctcagggcacactttttatcccttagtcctacactattctagaactcatttagcacaggcccacttgtgaagtgttgagattaaacttgtcagccatcactcacagtctagcaacatgactaagcacgtattttctttctctttatatttaaggatataattttcaaaagttaatgtaagaaaggtttccttaatatcacatctatattcccctggtcagggaagccggttttcttcagagaaaatttgattgctagaaaaactagtaccttatttgttccttgggagtaaaatactatgtaatgaaactcattagtaacttgggtgtcctggtgatactacaattttcttgctaagaaactacagaaggtgcctctggtttgctgtcgttcccattagagtaagacccagaggtgtccacgtagatgctattatctgtgtttctttttgagactgcctgtcttcagccttttaaattggtgttttagtatgcattctgcgtttgacctttgactggatatgtgaacatgatagtgtgataattccgagtttgtggccagcaaggagctcctgtgcattaacctctagaatgttgaaagagtaatgaagagaagaaagaaagacctctcttgtcatcaggaggggggatgagcctgaatgcagtagtgctctttgtctaccaagaaaagtaaatgtttttatggctgttacatataatgactgcacacaatattcagtttggaccttgcaggtgaggtacttagatatgcctattttttattgtcttgaatgctttcattgcacttacacaaatcccagtgtcactacatatagaagagtgattcgtgtggatttgagattgagaagtagcactgttaaactgattgcttcaagttgtcctttggctcacatccttattgtggcgtgtgtgcatctgcgcacacacacacactcacatcccacaccctcagattaattaaggataatgctactttcccattccctctgcattcaagtcactgaggcaggtgggtgactgccttcttaatttttgaattcaaattctagcacatgaaatattgcctcagtaatgtgtaagtgccctccctgttttttgatacagaatatttttccattacaagtaatgagtgatcagagttgcccaatactgtgtaaaatgtaaggaaggtcaagtaggcaacaaatgcaaaaatcttatcattttatcacaaaatgcaaaacagtccttaaaactttgggaatcagagtagcactaccaatcttgtaagggttggttatctatggaaagtcagattaaattctctttgatatgcaatgtccttgaccttttggaaatactgttcctccactgataaatctcaaggtcctcttttcatttacaaatgatcaaggacaggttagtaatagcactaaaaccaacatcctttgctttagtcatcaggtaatatatttccggtaataagctatgtccttttaaaatttaatttaattattttggtttttggttttggtttatttttagtatgtatgtatgtatgtatgtatgtatgtatgtatgtatgtatgtatgtattttggtttttcgcgacaggatttctttgtgtagccctggctgtcctggaactcactctgtagaccaggctggccttgaactcagaaatccacctgcctctgcctcctgagtacggcaattaaaggcatgccccaccactgcccggcgctatgtcctattttgctcattagtttattgtgtaaggttatctaatgatattgaatcgcactatcaagctttgaacatatggttaaatagaatttcattgtactaaaaaaaaaaaaaaaagaatttcattgtactgctgagctttcttagtactttctcaataatagcattggaataatttgactgctttaatgggtgttattagcaaaccctttgatggtaattgtggaactgcttttcttgttcatggtaagtatatatgctctgtgtcactgaacagtatgtcttaatggaaagctgaagtaggataacttagaatcataccactgtttcttgtttcacgtgactttgacctgatatttgctgaaacaaatgaagtctttgaaatttaggtttcctacaaaaaacaaaggatagcagtatactgttcatgtgctctgttttctcagtgggcatgtgtgttgctagcctttgaatccaaaatatttttttcatgacttggtaaacagtgttagttttgcttgtattcacttgcaatctcttaaggatatgcaagagttaagtttctaggaataataaactatgaggattagacagtcgcacacagctccagtgagctttatttaatgacagatttgtgccatagagagttctggaaacactgagcaggttataagatgcagattcccagggaacaaacttcaagagagtgtggattacatgcttaagtctgatttgtatttgcttgttttcattcttcagttgtttgttcacttggggtgtttgtttttagtgctttgggtttttttcttctcaggataatgaggtgaattttattagaagccaatgggtaaggtagttcatttctttagctaagctgacatggcagtcagggtctgttttgtaaccaccaggcatcttggtaaggggaatctacctttattactccaaatatctggcttcctagaactttgagcttagctttagggagtgtggtgtttgattcaatatctttatatataaagggtatgggcatcattttttgactctacttcctgcttgggaggggagcatcatgcctttggggtctagagtgtgataaggaaggacacctgactgcttatctcagaaatatctctactcagaaatatgcaacagaagctgtggcgcctgcctttaatcccatcactccataggcagaggctggtggatataggagttcaaggacagcttgatctacagagctaattctaggacagccagggctaaatatggaaatgctgtctcataaacaaaaccaaaaagcaaaaaatcacctgtatatacgaggcacattggtttccagttattccattaaacagttgtacttgaatggaccgtgagaagacaattgatttagtctgtggtactggttttatgagtttcactaatgctgtttatctttcattgtgagtttctattgctctgtagtgtcctgaatcattttatcctacttctgtatgatgtgtcatgagaatcaactcattgtcttattgaaaacccatcaaaaataatttgtgtctcattgcatttttgtaggattatattttcaatatcttagactgtgtcaccttactgtcatgagtagatttgatgtctgggtaactttttgctatacgctgttcattcatggattgatttttgttttttaagcttcctcatttactctccttttgtgacttccattatgtaccctaactatagaattcttctaagacactttaattttttgtacaatgcttaagacttattacgagtgttatttgctatatatgttggattataacttatattttaccaataattgtctttttgtgataattgatactgaagattttccatttgagcgtctttgagatgagaatacatagttccgtgcagccctttcttctacctagagtgttttgtggttaaatgtgcttaggctttaacccaggaccttgcacatgctgggcaagtcctgctcttgtacaccttaatcttttttttgtttgtttggtttttgtttttttttgttttgttttgttttgttttgttttgttttgtttttcgagacagtgtttctctgtatagccctggctgtcctggaactcactctgtagaccaggctggccttgaactcagaaatccacctgcctctgcctcccgagtgctgggattaaaggcgtgcaccaccacccccggcctgtacaccttaatcttgaaaatcaactttaatccttaaccgctttgatggtccccattttctagtaaaactttgtttctccacttgatatgttcccatttaatgatcaccacaacagccttctgatgcattccagtgaggttttaaaggcaattatctaacacctaagcacaatcataaaaattctgtgcaccaggaagactatagtctacccttgcatatctaatatatatgtagaaaacaagcgcaggaactctgggtatgtgggatagagcattttggaggatgttcctgttgcctgctcatggtagagcatgtccccaacatgtgtgttacaaagggcttaatctctagcacaaaaaaaacaggcaatattattcacttctacattttgtttttggaatagctgacaatgaaaattacaaacagtattttataaacataatctgtaaatgggaaaatcacatcaaggatacattccctttgtctaccttgaaatgatccaaggccagccttgtctacaaagccagttcctgaacagccagggctacatcgagcaaccctgtctcaacagggtaaacaaggaatgaaagaaagattgatagtctcttactatgttaggtaatgtagcttttatgcaaactttaatcagtggttctgaaggcttaagttttcagtaacatattgttggagaaatttgtatccagacatccttattggccttgaattcgtttaaaggtattttctgctccttgtctaagggactgccagaaaatgggttatactgcaaggttgtgtttagttgagtatggatgagaattgggctcaagacactggagctgctgttcatcttcctacttggctcagagacatgacgatttataccagattgtctgtccattttaaacttctaactatgaatatagatacaccttaagggtcttcaatttcaaggtgcttattaccctataatcttaaaccccaggctaagattatttattgataatgctgccaacaaatgtcttttaactcatgagtaacttttgtcggggctacaaggggttttttaagagtctgtttccctctcagatcactttttcatgttgatctaaatgtttgtccacagttcaaatcatttattattattattattcagttctctcagtagtcaggatattgaattagtcccaaagatgagagatattcaggtatatagattaaaccttacaggctgactagttactcgctaagaggtttggggtaggatatatggaggagagttttacagggaaggaattttttgtcatggatagctgccatcctctcattccttagatatacatttagtttcttctccatagaagagccgtatctaggaactgccaatcctcagtaagacacggagatagcagcggtgccccatcattctcatctgaatagtctcttgtcactggcaggctttctcctgaactttatttttcttttgaagtgtttagagacttgaaatgttcattgctttactttgaagcatcagatatgtgtaatatccactctagggtttctgatctcaaagcattataaagcgaggcatgttggcacatgcctagaatcccagcatttcgggtccttatacaggaagaccatcttgactttgagtccagtctgggtttcataacaagtccctgactgaaacaaacaacaaaatctatgaacatgttttctactcagacctatcgtattgatctttactattcaaataatgcatttataatgaggacaattttacttaagtaaatggttcagatttgggaaaggaagctctgaagtgtgcatgcaaacagtgactctagggtttgggcataggcattagctggcctgtttgttaattgcgtccactcaatgctatcttagttattgttgctgttaatgatggagcgggcaatgcaagaattaaaagaagaaagttaattattattataccttttgaatggtcaatggtgttgtggggagggatcatggacgtttttaatgattcactaatgtgaagttagcccatgtaggaaactcgatgattcttccattcatgctcttgattagtaatctattgcctttcttctttgttctaagttaaaagcttttgaaaacttgtgttatagctgaataaaggtttttgtataaacacagaaaaggatgtttggggaatggtcacagttgacctgaagccgaattctaactgataactagctatgttagttcttgtgactgtcatccctggagagcaagaaacaacagctggccttggtgatcaggagaacttcatggatcgcgcagcaacctggagtggtgttcctctgaagaaatcctactcgggtggatataatacaacctgctaagtgttctagcacttagcaggttgtattatcattgtccgaggttatggctctcgtctatcaaactaatccgtaagggcaaggatggtgactttgtactcacagtgcctaatccggtgcacattgtaggcctcattaaatgtttgttgaatgaaaaaatgaatcatcaacagacattaattgggcgcctgctctgtgatctccatgggctcagcttgttcctgccagtggccttcaacgttcaagctctccgcagcgtccttatttctgcagctcattcctgtgttctgtgtagtataatcatagtggatatattttacctttcaaaccaattccaattgattgataattgtgcctcgactgtgttttataaaaaggattccatatctggttcttttctatcctgagggtgtggaaggaagggataatagctcatgtaccataaatgtgatattttctatgaaatactgtatttatgcctgtgttttggaaatgcctgcttgtcattgttgcatctctgttgttgttactataatcgctaccgattactccctaggttggactacagtgatcactgagtaggagcttcgtctttaaaatctggggtgtgctgttatggttggtattcattttcctttacccgctttccccatacctccatttataattttattgctgctcatagctccagaaggatatagtaacagagcaggcatggcctcagtgtggtaagctaagtgagaacaggaagtggaaccagggtagaaaaccccagtcttgcccctagtgacacacctcaagcaaggttctccttctgaaaggtcccattacattcccaaatgtagccaccacctgggatatgagtgttcaaatacatgaggtagggccacggtgttccttcaaagcaccacagagggcagaatgtacaccctgctagaatagctttctatgaaaggatccatctcttcactggagcaggcagacatatgaagaagacaacttggagtggtcgtgaaaggatttgaggtttggcatggactctaagaagcacgagatttgtggttttccttctttgtttcttgctaggtagtcctggctgtctagtaactacctacaaagatcaaggagaccccaatcttgtagcaatcctgctgctgcctcacaattgttaggattatagacatgggcacatgttcattagaaagttgcactgttctctaattcatcttttaagataaactatagagggatgaagattagcatgttacaccaccacagatagaaaccattctagtatcacgaaacatccaactcatgtagaatttccattcgctgtttgggatgatagagagatggaattgagtttttagaaggtaaaccacacaagagagtctagggaactgacagagcctggctggactgcacagttcgtcctcaaacgactttttactgacccagctcctgaggaaaggaccctggtgtctgaacttcaacgctgatttaataatcattgttttcatgactggtcctttagaaatctggcctgctttatatttgcccctggggcttagacaagggagaaaaatggaaaatactgtccgaggtaaccacagccacacagaacctcatacaccaagtggttagccttatcatagagcacaggtgcctgttctcagtcacatgctagccctgtcttaggattttgtttacattaaccattctatttcacagtattaatgtccttatacacaagatacacagaaatctttgttgtgttagacatcaacaatgaaaaatccctcaggcccaaatatcagaagatagcacgaaaataccaagtcagaacgaagagggtggccagtggatttgaaggtagatgcagactttatcatggttactcctacaatacagaacattcttgtttattagtctgataccagccatctgatgtcatgttggcaactagagaagctttatataagaacaggagctctgtaagaaaatattgtaggaattaggctttataagacaatcgtggcccttggcagtcttggttaagtctcttaggatggttagggtagaacttaggtgtgaaaagtcttgactttcaattattctacattgaattcccagaacacctgagtcaagctttattgtgtttattacccttggtcttgcctcctcattcttgtgtggactccttaactcctgcctctctttacccaacccaaatgtgtttcagcaatcttctttccctgcccagtactggatctgtgaaaagctgaatcatgaatcagtgagtgtgcggattggaacccaagttgctctctggatagaacgaaaggagtcgtgccccaagaagatggagagggaagttatgaaatgctgtgaccaaataacaaatgctgatgtttggggagataactgtttcccataggaaatagagtgaatgcgatgtctttcttttgtgagggattcatagaccgcttctcaacgcttgttacatgttactccttttttcgagatttttatttacctaactgggaaagaaaccagaacaaggttttcattgaattctgatacaggtatttaaagacttacggacaagatatagaagaagaagtggtaattaactgattaaagaagtacagtttatatccagtagacagacaggctccagacatccttagtgctgtcttagcatcaaaggttaatctacctaatacttgtcatcctgaaatgcatggtggaacatccaacagacaagagctacttcagggaaggactatgatttttgtcgtggaagacatttaacacagggcagctcctgtgcacttacatgatagatattgctcttccggggactctgaatgctcatcccactttcagctcactaggcacatcgaactagaaattttatcatctcgtgaattagtccaatacctgaaggagcaagagaaccaacacccagttgacaagaatatgacctgttgattgaagaccattaagaaagtaacttgattcagttggactggacttttttattctattgaaaaaggaatttatttcccctcagtgaacgtaacatgatcaacattttgaaagttgtgaacatgcatagttctataatttacaaaataattataaaaatctgagtatggatgcagcataatttcagaacagaatagccatcatactttttatatatcttaaattcgagttttcaagagtatatttctatgttatatcctttgattagtacaatataaaatctacatctaatatgtacttcaggttttattagatcatgccatattactgtacaatttggacttttccatttttatataaaatgtaacatgcattgtacattaatatttatatatcttgtttatttatatatctttagaattaatttctgccaattattttctttatttgaatacttggggtatcataaaggtgctgttgaggtattctcaatatgcttgtacaacttcctgcctgtagttaataaatgtggatatttcattaaacaattgaaatataacattttgatggtatctgattgtagttctatagattgtaaaatatatgtagttgcatatcttcagtccatgcagactgtttttgtggctgggggttgtttcctggagagggtgtgttgccttgccttttcttgagttgtgtatgtgccatcatgccgagcagttggaagtcttctaaattcagtcactttttacccctttgcgtgggaacgactaatttgattgatatacatagctaatattttgacttctagaaagtgaaatccgtagaatcatatgtaatgtttagagtttggagtctggctgctctcacttcctaaatgtaattgagatttacccatgcagatgggcattagaccattctgtagttatttaacgtggaatatttctgcttctgacagttacaagcaaagttcataggtaattttaggtataattgtccttagctctgtgtatgagtcaatatgattatagtagccagacactagaggtatccgatttcgcctggacctggtgttacaggcatttgtcagctgcccaacatgggtgagtttccttttcttttggtgtttaattcttcccaccttccaaatattaattctgtcagaagatctgccattctttcctttgctgcgcactgtactttcatgtgatcccatttatcagactttgctattatttcttaagctgttgtagtcttttgaagaattattgcctatgctattaattcaaagtattctccattttcctatatgagtttgtggctttattttaaggtgttttatccatttttttatccatgggaacttttgttgaaagcagggagacatgtccagtgtttacaactgagctctctgccattggctcccactttggtaagggagctgaatgatggctatggctttcaaatatatgagatagatgcccgtggtacctaatatggcaattcaccgaattcaaggtacaaaggaaggccatctgaaagtgataggaccagtgagcgttcctactaagtctcagaattattaccctcccccaccaccacccccgcaaacaaacaaaaatccctgtggtaaaggccccaaggcatgggattgtttcccagtgagaatgcataagcacaatagtttgtcagtattgacccaggagtagaggctgaattcaccattgcacatgcctatgtcagctattttaataaacttattcaggtaagtggctggagcgatggctcaggagcctttggttggattcccagcaccctattttgccttctgcatggaatatgcgcatacatggtatagagacacagagacatgcaggtagaacatctatgtgcataaaacactaccaatcatgctaatagtttttaaaaggaggttttctgcgacatccatgttaggtgtctatgcagtgtagtctgaagtgtgatgttggtgttattcgttggtctgaggattgctttggctctttgcatacgaattgcaatattttacgctagttatctgatgaatatcattcaaatttgcacttaatttgtagatcacatcaattaatatgacttattctatgtttagtgttgggcagtgtctagtgtattaatctgcttcacagttttcatttctgagatcttggttacatttatttatacttgtttaatatttataaatctcttatgcatggaattttttttagtatagaatagagtttatttacaacatgggaagggagttgaggctgtagagacaaagaaaggcagagtgagagacagtttatttacaacatgggaagggagttgaggctgtagagacaaagaaaggcagagtgagagacgggggacggggggtggggaagaagtagaggccgtccatgagcactaggagagagagcaagagggcaagcatgaatgtttaatattacttacagagaagctgcaggtggcaatggtttgtgcctcatttctgtagctaagaattcaaaactatattgactaaataatatgagggcggggcagccctatgtcattcctcattgctgagaaaagtttcaggtagacaccattcatcattgtgttgtctctgcattgagtatagcacttatactcagataatattcttcttaaagcattgtcagcatctattaagatgatcatgtgatttctgaccttgattctgtgtatgtaaaatatttcatttttttgtattatgaaaccatcttttaaatgaaaccagtttactatgctctgttgtcttttcattgtgttcttgaatttagtttgcaagtattttattgaggatttatgttaatcaaggacaaaatattttgcatattcacagaatgtgcttggatgaagtcctttctgttatatggtagaattcagcagtgagtattatgtggtcctgagcttttcttcatttggaagacataccctggatgagtggttgtctagcattcaatgatgtgtcatcattgtacaaacctgtatccccagcactctgagaagaacactagaaagaatagcagttcagagtcgttctcaagttcatagccagttgaagccttgaatatatgtcacctgttcttaaaaactttgggtgtgtgagtgtgtttgtctgtgtctctgtggtgtgggtgtgggtgtgtaccccgagaattgcaaatttcagtcataggtgaaaaaacaattttggtggtcaaagggaaataatgtatttatgttctacatttattatttcccattaactagtagatttggacataatttgttcctttgtccaattccatgaggtatacagtttgctttagcattcttttttgatgttgtagtttattgctataagcttcccttttagaatccccttccctttgtttcaaagcctgaaatgtgttgtgtttacattttgatttgtctccagatagtttttgcttcccttttgattgcttctgtgacccactgattgttcaggggtatgttgtgtcatttccttgtatttgtaaaatttccaaacaccttcctgttatgatttcttatttcatcactttaaggtcagaggtattactttaaattatttcaatctttctaaatttgtcgtggctgtgggtggccttgaattcgagctgcagcaatttttgtatgtgcttgataaggtgtatgttgttttagtgatggaatgttctggatgctttcagttcatttgcacttgcattttttctttcggtatttccttgctaatttcctgcctctgccctatgcactgttgaaagtgacatctacttgctttgtgtgcttacatcttcttgggagcacaggcatttactacatcctgattggcttcttcttagaagatatgacttagcatatctccttgcttgtatttaccatttatatcaagtatcttttttgattcccacatcttcagcatatatataccctcaaatagttatatttaatataattgtcaataaaactttacttttatttttttctaagattcacttgtttctcgttgtttctctctgttttagttgttgttgttgttattggtttttaaccctgggctaccctgaaattcactatgtagctcacttgaacgtaaacttctaacacatgtcctgtcttagggtcccaagaactccctgcccccagaatctctccaccctggtgtacatgcttaaaaatgcagatattaatgctggacataagggtctaggtgtggattctctagtcattgaacacagcctgtgaacaaagctcctaagatgctcagacaaccttacagagttcattgcagattcaccaatgcatgagattgccctgccacaatgagaaaatcctcactgaaaagcagaaattcataggaataaattcagcacaaaataaatgcagataaaagttatttttttaatgagagagaaagcccagatggctgagaacttaaatgttcaacatgcttagtcaccacagaaatgcaaatcagaatggctaagatcaaaaactcgagtgacagtacatgctgttgaggatgtggagaaaggggaacactgctccgttgctggtgagattgtaaatttgtgcagccactctggaaaatctgtctggtggttcctcagaaaagtgaaaatagttccacctgaagtcccagctactgggcatatatccaaaagatgccccagaatacactaaggaaacatgttccactatagtcatagcaacgtcatttggtagcttcgggttctatgttctgacagtccaaatatattgtggactcccaggctgcattttcgtaatctcaataggagcattctctgtagaggtccacattttctccacacgctggaagtgtccctaaggagaaggctctgtcatttctccatgggtctgaggctgtggtcattgatctgctgttttggtggcaaccttcagtgccagcagtgcacatgaacttggaacttcacttaaggccttccctggtctccacagagctacattcatattccaggttttttgttgttgttaggttttgttttcttgttcttctttcttctctgacggtataatttcaactgaacttcaagtcaaatgaccaagcgtactgttgaaggtttcctgttgagttaacattgtcataattcatttgctgttctgatttttgaacttttcatttgatttatgacaaggcacgctctagatgccctagctaattttccctctgttaacttactgtagggaaaatgtttgttttaggttccattaattaattgcttctgtgaaccccccttgctgcatagcaaggggctatgatgtggacgttgccttcggaaaccctgtgctgtgaacattcactcaaaatccaaattcctacgtgtgctgccagccaacttgatataaagacattctattggctatgaactgtgtctgactgatcatctgggtgggggctccccatcatagagtcaagtattgttttcttgatttcattattttctctgtcttcctgcagctggctgagctttttaaagatggctattctgaattcttcacaggtaatgcacaaacctgcatattctaagggttctgggagtttattttgtgactgatagtttcatgtttttcctgactttgttcttgtagccctgcatgggcaactgtccatttggagaaggagcctcctcttgcaatctttacagatattttttggcgcaggaaaaaagaattaaaagccttaaaaaacgatttctaggaataggagctgtaatggacccacaagatggctcccaaccatctgtaactccacagtcaagtaacttgatgcagcttttgacttttacattcacctatacaaatgtggtgcacatgcatattacactaacatatgcaaacacagaaaacagaaaattttaaagattttctgaaatgtgtcaagctttgcctgtgtgttgtgtgtgtgtgtgtgtgtgtgtccatgtccttcacgcctttccactgtgggaaaatgtaatcttgtcatttgccaatcgcacattccctttctaggtgttttgtgccaggtcgctgcactgcgatgaaaagatgatgacgcaagtttctctcattctcttcctccagatggcacagtgtcagaatcgtgtgtggcctcctgctgcctgaaccatgccgctaagacagttgcccactgtgcagcttcacaccatctgcagagagcaacactgcagagcctttgggagagccttgccagtcgctgaaagcctggctgactgccaagccttgcactgtagactgaaaattgctctctttgctgagctcagtactaacacttagatcttcatggtctcctgggagaccatgtcagctgctgttcagtgagataaatttggatcagctgaagatatgcactctctatgccttccttgactgtcagctaaacagtgtgcactcctggcttagtacagccttggctgctgagagccccattcctcccctgtgctcttcattgtcctcatgatctggctttcatcatccattatactcctaacactgggagtgaagtgtcattgaagaatgttcatcaggcactacctcaaagggctggagatgattggtgaatgctttgattcttcattcctcctaggacacatatcaagcccccagaatttctctctatccagttgcaccagtgtgaggaacttgacggtgtcaggaaagtgaaactgcttctctgctccatataaatgtctgtgcagatgcaaagccatgcattacatggtagctcacctttaatcctagcactcaggagacagaggcaggaggatctctccgagctcaaggccagcctggtcttcacagtgagttccaggacagccaaggctacacaggaatcctgtgtacaggtccttggtattgcactcctctctataaacacaacttgcttttagaatgtgtggttgttaagttgttctgtgaaggatggataaaggctagctcactactacacccgtcagcttgctcctgtcacttcttctcacctttgagcacttagcatccctctccgtgttgtctttgctgaaatgcttgctaaggcgaagctcctctgtagctgtcctctagccccagccaagattctttcaagatttttctttggccttctgtaatttgaatatgatgaatgtttttatttactacttcattttgtattttgaatcttttttaaaccatgccaggttctctaggctcctggttctgatatgaattgagcgattatcttaggcccttgtgtttcaaatctttctttctttctttctttctttcttccttccttccttcttttcttttcttttcttttcttttttttttttgagacagggtttctctgtatagctctggctgtcctgtaactcacccggtagatcaggctgtccttgaactcagaaatccgcctgcctctgcctcccaagtgctggaattaaagtcatgtgccaccactgcccggcttactcaaatatttccttttttttttcagtcctctctagtgatctcattatacatgtgtatattctctagttgtcccagttatatgatgttcttctctctctctctctcttccccccaccctgtgtgtgtgtgcgcgtgcatgcgcgcgtgcatgtacccaaggaaactagaaaaggacttcaactccttgacgaaggaggtacaagcatttgtcagccacctgatacaggtagcagaatctaaactctgatccacattattaagcagcaagtgctgttacctgctaaactatctcgctgaaatttatctcttagaaagtttctaatatattatcactgtcagggattctttggcttggttcagtctgctaataagcttaggaaaggcaattttcattttgttgcaatatttttgatctgtagcttttgttgttattcttgttcatttttcaaaccagggtttctccacggctatactggaactctctgtagactaggctggcctcaaactctcaaatatctcactgcctctgcctcccatgttctgggattatatccctccactgcccaacagcatttattttattcttaagatttgtttttccctgctcgtttgtttgtttgtctgtttgtttggtatggtcatttgtttgtttgttttgatgtatttgaacttgctatctttatgtgaggataagcctaagtgtgtaatatttctgtactcatctcccaaatgctgaaatgtagacacgaaccaccacacactaggtttgtttggttttcttttgcatgcatttattgtattgtgtacagtactggtaccaaaggagtccatcacattctctagaacttgaattacagatggttgtgagttgtcacatggtgctgagaattaaacttgatcttcttcttttttaaatttaaatttcttcacttacatttaaaatgctatctgaaaagtcccccattacccccccccctcactcccctacctacccactcccactacttggccccggtgttccctgtactggggcatataaagtttgcaagaccaaggagcctctcttcccaatgatggccgactaggccatcttctacatatgcaactagagacacaagctctggggtactggttagttcataatgttattccacctatagggttgcagaccccttcagctccttgggtacttgctctagctcctccattggggaccctgtgttctaaacttgatcttctgaagagtaaccactattgattttaactgctaagtcatgtctccagtcccaaaagaggtttttttgtttgtttgtttttcattactgtgatgatcctataatgaagaagagaatgctggtggtttgtttatgtgtttgtttgttttttgagacagggtttcactgtgtgtccttggctgccctggaatttaagcatcagactggccttgatctcacagagatctgcctacttttgcgctgagattaaaggtctgcactaacacctcccagccagatgtctctttaacagactgactttacttcctcacgagtattatgatggtttcttcctgtcctgtgaggaatgctattgatttggggtttggtttgtggaatttttgttttctggttttttgtaatttttcccccctaaatatcatgctgtcttattctttggttaatttttttttgccatgttttcatttattatgagattggggacacagcatagaatacatgacaggattagagaagagcttgtaggggtctgctctttttctaccaattaggtacagggatcagtgtcaggtgtgacatagaactgaacttgaagtatcagaccaagaaaagcaatacacgttccatcctacccatgaggttgtaagagttgaaatattttttgataccagtgaattagaactgaccatcattttctagagctaccttagcttcaatctctgtcaaagccacaaagatttcatagctgatgttcttcaatgttcccagctaccagctcagtgcagtcagaacacgtattccttcactaatgcgtaatccatttagccaaaacttaaatgtagtcctctctttttttctttttcttcttcttcttcttctttttttttttttttttttttttgttttttttgttttgttttgtttgtttttcgagacagggtttctctgtgtagccctggctgtcctggaactcactctgtagaccaggctgacctcaaacttagaaatccacctgcctctgcccgagtgctgggattaaaggcgtgtgccaccaccgcctggcttccagatgttttctgaacattaatcaccagaagatttgggaaacaactgcttaatgtgaggtttatataaggcatctgacaatgaaaaaggaaatacgaagaaacttgactacagtttcctttagcacttttagcacaatatcaaaggactttaggaagtccaatcaatgttctagaagttttgtgagatcagaatcacaggaaagtcaacagatacaagattaataaaaggaagaaagagtgaaaatatgtctttgcccaataataattttagaagtaaatatagtaccaatgtccattaagtagacacaaaattgccataaatggtatcaaagagtggaatcatgatccagtcttagctatgttgctcagtttgtagtcttttttctagtatatatgatgcctgagattcaatctgcatcattgcgtaaaataaccactccgtataaccagaaccccataaaattgatagtggtgggacacacctgtaatttccgaactccggagaggtatacacaagaatgccagaagagaaattcaagataattcttgtctacatagctattttgaagccaatctatcctacatgagtatttgcctcaaaaaaaaaggtgtattccttatttagaatttattctgttcatttgttgactttttaggtgtgtgttttgttttgttttgttttgtttgtgaatgggtgactgttagggacaagctggccccaaacttctaagctgtgatatgacaggacagcagaagccatggggtagaggtttgacctaggagacaagatgtgtttgctgcaaagggtagagccagaaatgtggatgaggccctgcggctcccagagggttgtacacatcaagcatcgcatgtttggcattgctgaaatgtttgttttcttgctttgattctttgttcttcccttttggaatagaaatatgtgcctctttcttttttaattttcaggagccacagttcgcttattttaagagatatcttgggaatatacaaacagacatatctataatagttctatctataatagttctatctataatagttctataacatgagcttgtaggcaagactatgagacattttcttgtttattgattgatgtggaaggacctaatgagtggtgctatgctagtcaggtaggactatatggtatgataatgactgttttctcgaagtgtaaaatgaaatcaagccattcatcctcaatttggttttggtcatggtattttcttacattattagaaaccctaattgagccgggcgtggtggcgcacgcctttaatcccagcactcgggaggcagaggcaggcggatttctgagttcgaggccagcctggtctacagagtgagttccaggacagccagggctatacagagaaaccctgtctcgaaaaaccaaaaaaaaaaaaaaaaaaaaaaaaaaaaaagaaaccctaattgaaacacccactaaaccatcttgccagccctgaccttaagtttctaatcctgcctcgtccttattgatactagaattaccacacatggttcataccatacttgggatcaaacccaggggtcatgcctggtaagcaagcactgtttctactaagctacactgcctgcccctaaagtattgtttataagcctttataagtattatttattaacctcacacttaaaatgctaagataccgtactgtgtatctgtttcctcgtgtaggaatctaaaagtgaacatatgaggctcgaattgggaagccacccaagcatgaatatgatttaccaggctatcgggccttgccatggctaccctctacacatggtagagagcatgctcagcctctgcctgttgtccctcatcttcaccactgctgcggtgataaccaggaagccaagagctagtccggccttgcaggccatgataaagccactgcaccttagaagttatcatggtccaactaaaaaatgccaaaaacaaatgggatgtttctctgcagtatcctcctaatattacaatgaagtttgaaaaggtatatggagacccaggcagtggtggcgcacacctttaatcctagcactcaagaggcagaggcaggcagatttctgagttcgaggccagcctggtctacagagtaagttccaggacagccagggctacacagagaaaccctgtctcgtaaaactaaaaaaagaaaaaaaaaaaagaaagaaagaaagaaagaaagaaagaaagaaagaaagaaagaaaaggtatatggcagctgagggaacctagccattagtcttttattccactgtggaatttcatttattttgttcccttgtagctgatgagttttaagcacctaaaacaaggtacctttccttcccacccccaaactgaagactttcttagaagcagggcatgcacaagaaattcctgacgttactaccttcctatcttcacagtttaaaagaataaaggaaatggctgccgaagaggtggcctaaatcctagcatggcctgcccacaggcaagctgtgactgatgctgcggcaggtttacagtctccctctgtgacttgtggcacattctagccctgtggctgagtctcatgccaggatggctcagctccaaggcaaagccccatagtgttcattgaagtctctcacccactttgctttctgggatgggcatggatggtggcagttctttcccacctaataggaaaaagcgactgccaagtaagtaacccaggccctttgtctagattatcccttgcttaggcagaaccaacaaaagtttatactttaggtttttcaaattagggtttttctgtgtaaccgatatcatcctagaacgcactatgtagaccagggtggacctgagatcctgagttaatcccagatgtcttgtgctgggattaaaggcatacacctcggtgcccagctggacagattcttatgactaatcatttcttctttctgcccaaacccaaacaggccccagagtgacaagtccagccacccccactccttctttcctgtccacggatgtttaagcagagagagggaggaaggacaaagcaagtttaaaatggaaactaaaagggggaagacaaaaaggaatgggatagtggtgaataatcaaagaataaatacagccaagcagggtggccaactctactcactgcccttgagcccatttgctggaagcattagggttgacagcaacattgaagaaaacaactgtgtgcaaaggacacagtgaaatcaaaaacaaaaacatgaacaatgccattccatgcttagagggaattattttgttgtagataaaaggctgagaatagcaaaaagcagctgggggactctcctggcctaaagtgggggagaaggaaactggctgttgccagggttttgagagtagagaagattagctggaagagcctggaactagtgcagggcttaaaactgctagcggtttgactgaattccggaggttgcagtgaggaaggagcagataagagggtaatggcttttcctggcaaacaaagcaatttcgaaaggttactgaggaatgtggggtgtttactgactgggtcaaagtccagtctgagctgaggataagaaggttcggacctgaaatccactatagcagttgaaagcaacatgtctgtgattttctggggctattgtgggtctgtatgctgtcggtaaagtaacttcttcccatgcaaaactaataagatgctaggcaaggagccatcatctttttaaggtattgtttgataaagagtacagctcttctgctcgacatataaaacagagagaagtggaagaatccctcttttatttaagtgtacccaaggggtagaatctcctcatgcaacaccccctggagtctccagatgtggaggtctgtggaccatagcaggagctttctccaatgtccaggcaatggtccgagtccaggattctgtgcagttgtttgagcagccttccaagctccttccagtgtctgcagaaagttgctgaggaatagggtgcatctggcacaacttcaggctgaacaaacctggcatgtatatggtgctcaaagttcccatcacccacaagggagaaagattgccgtgcgcttctgctgtggtacacagaggaaagaacttgcctgtgtttctgtgagctccctatagtccagggagcttctctcagggtttagctgtgtgtgtggggggggggggggttgtgtgtgtgtgtgtgtttccatgcctcagaagcaagagctctgtttctccttttcatccctaggctttggaaaagtgcaccaccttggtgtatgtacatggcgctggctgcctgtgcctttgctcttgttccacatcccactccttccttccctggtaccagtgcctctctctgatgagctgatgaaagctttaatccctagctctcctctgtgtggaggcttcccctttgagggaggcagagcagctgcattcagcctggctggggagctgccagctgcagctcctgctctggcctctgctggtggctgcagtgtctcctcagagggtccctcccctcaggcctgtctccgctcctgtattgtgctcctgctcttaggcagcagtactgaaaagcctcatggcacaggcagaaggcctgcccctcccccgccccagccagacctagcttttcttcctaggcagggatgtgacaaaaggcttcatcttcatgcctgctctggctctgtcaccagcacaggccaggaggctgtctgctgggtggagatgctgcctttgagtatgtgtgttaggggctggggcagggagacagttatcatccagaaacccagatgtggagctggacaaccaggacatgaggggcagtgggcctacctaggggcttacaggccagccccagcaatacagaggaccccgtagtcaggaaggagaagccaccacagagaaaaaagtaaaagaaatactgccttggcacatactgttcctcctcccctactcagaagctgtgagacgggctccttccttttttagttggccctcctactgaaacagtgttgttcctgttctgagggacagactgaaatcagtgcaacaagcagccttccttagggctctgagtgcaagtgtcagtgagagtgtgtgcaggaactctccactgcagcttttttttttttttttttttttttttcagtgcaacaagcagcctttgtgtctatccagagcctcatgctgaaagatactgtagcagccaggtatctgtgtctttgtccccacattcttttcagggctgatgctcagaagtgaggtgcctctcccccacttgggtggactcagaagacagaggattagacaaaacctttctctctctctctctctctctctctctctctctcatattgtactttgtgtgcatgaaggtaaggaatcacgtcagcttgtggtcatttttctctttccaccacatgtgtcctggatattgaattctattcatcaggcttggtagcaggtcacaagtcccattacccactgagccatctcacttgtcctaaacaaagaggacattagagccttaacagtgagcagagtttctccttctactttttggacttgcatggaagctgggacttgaacagaaaagatcccccataagagcgtgttccagcgtccgtgctccagttgctggtgctgttggtgaaggttgtggccaatccttggaaggcctgagtcaatgtgtgttgctgacttggacaccgccatgtcaaggagcataggctcagccccatgcagtggccaggtgccctccccatcctcatgcaggtcagaggaatgctaaagtcttccttagggctctgagtgcaagtgtcagtgagagtgtgtgcaggaactctccactgcagctttctccccctgagtacttatggcctgaagactggtgccctacagacactgtgcctactgaaactagatcaacctctcttcctgatcagctgtataccacaattcctacctccttgcttatcaccaggcaataacccaccaccccattggactctacataataaatgtgctgtccttccaggctgctgtggtttctccatcagtatcctgttcacccaactccagcttgcctgtgtgtcctcttgtctatttattccctgactccccccctccccaaatcaggtcagtccttaaagccatgtaaggatgtgacagaaggttatggaatcttttggaggtggcatctttagaggggacagaaatctcttggagagagtgctttaaggttttatagtctggccccatttcctgtttcctttgcttcctgtgttgggagaaactgtgatttgctggcttcctgatagccagggcaaaaagcaaggtgctcctttagaaatgcacaaagacaaaagagcaattgggagagattataagagtgttcaagtacaaagggaagacagtgtgaagccagatcctctctatggtcacagcaggacccaacctttcttatgctttagcctcagatgactggcctacagaactgtgtgaaaggaaatgttatttgatcgtgtgtttgatggtcttgcagatcaatctctagcttcaatagtgttccggttaaaaaaaagaaaaaagccagggagcaacagaggagtagtagggtccgcctttgataccaatactccgaaggcagaggcaggcagagctctgtgagtttgacgatgccagcctggtctacagagtgagttacatgacagccagggctacacagagaaaccctgccttgagaaacaacaaatcagagagcagagccttcctcattcttccactctagtttcaagagggaactccttgaaccatcttcttggtcacctatttcctgcaccagctaacatgcgttttgtgtgtctatggttggtcaattcctttgctggcctaccaggggcttccacacccatagcaattgtctaaccaaggcatggttctgatggagaagaaggtacttctgggaggtggctaaggagcataaaggcagtactctgttctacaatgtgtaggagccattttaagatgaatacggtaaaactctgagtgccatgcttaaaaaactttgagaagagcataaatctgttcgtttctggatgatggaacctagagctctgtctcacacagagctcaatctttatggattcctctatatttaagtcttaggttagggaaaagtcaagaaaatggccataaggattggagagatgcctcagtagctgtgagcactggctgctcttccagatgacctagtttgaattctaggcacccccatggcagctaataagcatttacaactccagttctaagggctctaacccctcttctggcctcagctgacacttgtatacatgtggtgcacagcatatatgcatataaaacatacgacacattggaggggttgggggagggaaggctctcacgggaccagccgccataggcttcctggttcccaggcctactcttcctcaatagcttgtcttcacgaatgatgttctggaggtatcacatctcctggtgagacggtcagttttcctgtagggttcatgtcttgcttccacctacatgattggtgtaaggtgagagtaaaggctaagatgaggatggggagggacttcatttggcattccagagtaactattcaaatgggaaaatagaaaccttacgattctcagtgactgcaggatgccaaccaagagcctttgggatgtgagccatgaacccaaccaaaacccatagatggtagggtatgacaacggtcttctgaaggagtctactgggagcaggccgagggtgaatggcagaggcggtgggtgttaagtttctggggcagcttaaagacaggaagcagaaaaagagacccatctgacctcataagatggggccatttatttcaactattgaaggaaatatccagagtaaggaaggggtgtcttcgaaagagcgaggtatacttgagtttatacttgagtttttacttgaggtttgagaagtactactggatctatagcagttgcaagcctgaagtttctccctcctggagttgtttgtccagacaaggctgttttatctttaaaaactcccttggccctgcctattagaatgggggtcatggccgggcatggcagcgcacacctttaatcccagcacttgggaggcagaggcaggcagatttctgagttcaaggccatcctggtctacaaagtaagtgccaggacagccagggctacacagagaaaccctgtcccgaaaaaacaaaacaaaacaaaagaatgggggtcataatgggcactgagtttggcgatgatggggaagagctagagtttcaatatagggctttttggtcagggactagcaatgtttttgcttgttaacaagtgttaacaacaaaggcttgttaacagtgtttcaaggcaggaaggagtttcctggtgaagcaagtctctggtacaaatgatggaattcttaaagcaagaacgaatttcccgcctgaagtaagggctgagtgttttagagcagtagtggaaactccagataggggcatgcagcgcggtgtctctagcaggcctccagagctcccagccgctggttgagccagagtctaaagtcttcggaagaacatctagggagtttggccctggaaaaagccagttggctcagagctacactaggaggcagattgcagctgggctgatgaataaggctggcttattggctgtgtgtgtgcgcgcgtgtgcgtgtgcgtgcgcgcacgtgtgcggtgtagtgtggaataaggtccaatgagaagaatggctgtcagctcaggaagtataaaaatagaatgggctttcaatccgagctactgtatgtcccctcttctctctccctcctctgtgttgcaacagaaggaagtgtgagaggggatagaaggagagagaggaggtgaaagctggattttcacatctgttcccacttttggattgcagaaaccagttgtggctgagtgggtgggggagcagatgggggcagtgcaggattgagttttttgttttttgttttaatctctggctgccaactggaagctgcagtcatttgctgcctccaattatacagactgtcagcacagtctgttgcaggctctcttccagaggaggcttcacctccatgagaccccaaacatcactgagcacccctcctatattcgcatcagcacttattcctgagcctctccctccagcgggggcaggttttttgtcaccccaagtcctcctctacacctgaaactgagtgggaataatgagaatgctttttaggaccgggcatgtagcccagatagaagagggctagcatgcacaaagtcctgggttccatccctagcaatgtatatgtaacctgggtgtggtgatgtgtgcctataatagcggcactgagaaggtaggagcaggaacttaagttcatattcattcttgactgcacacacagtcagttcaacgtgtgtacctgggatatgtgagatcctgccttagaataaaatgtgagagaggggagagaaggggagagggagggagagaaaggaggggagaatttgcacaaaataagcaataaaaataaaagataaaagccactggttctgtgatgacttgttatggtagccttggccaatatatccttttggggagatagtagacatttaaacatgtttgaaaacctgacaaggaaagtgtcaggaatttatcctggcttcctaaagacactagatctcaggttgaaggaggtgtacaattcatttaggacacatagacacatggtaggatggggctgggggataaatcaccactaaaattcaaaatttttaaatatattggacttgccgggtgatggtggcacagcctttaatccgagcacttgggaggcagaggcaggcgaatttctgagttcgaggccagcctgatctacaaagtgagttccaggacagccaggctacacagagaaaccctgtctcgaaaaaccaaatatatgtatattggacttaaaatgtgttgccacttttcctgagcagagatgaacacacatcagttcatgccaggtagggcaccgacatcaacagagcggagactcaacccatccaagtctaccgtggcgttgcaatgagttttgggtagggaggggttaataggtgacagctcactgaagctgtatctctggactctctagaacttgcatgtaattttggcaataaatttgaggctctcaagaagagagtagcagttgtttacagtttttataattttggggatggatcttacgaaccttctaatttctgagcttcctgtgttttgtgaaccaccctcttccctctaggacagaatgtttcaattccaaggaatacaacgttacaacgtaatattcagtgtgccaactcaatcccactggaagacactcttaatctaatgccatacttccatgaatttcccaagaagggtagatgtcatcaaaatcatatgcaaattcgaggaagttgactcagcaccctgtgtgcagcacatgaacttctgcattggagtccacagcactcgcttggcgcggagagctatctgtaatcccagcactgggctatggaattggacacgggaggaatcctggagctcagcctagctgaatcagatagagacccaagactccacaactcaaaataataataagaaaaataataataaggtggagctgattgaggaagaaacccacacaaatgtacatatgttagtgactaagcaaagcaggtactttcaaaaacagactccctgttatgtattaaatgtattaatacataaatacatactattaatgtattaaagcttccctttattttctgctaaagccttatggtgcaagcccacaggcatttctgttcatctctggaatctctgatatatgctctgagacttttgagctacacagcaaaaatgtatctactatcttttcctttgaaattgtactctttttttttttttaagatttatttatttattatatgtaagtacactgtagctgtcttcagacactccagaagagggagtcagatctcattacgggtggttgtgagccaccatgtggttgctgggatttgaactctggaccttcggaagagcagtcgggtgctcttacccgctgagccatctcaccagcccttttttttttaagatttatttatttattatagaaattgtactcttaaactgagctaggtctggaatgtattcctaaactcaacctgcttaggaatcagcaatcttctctctgactaggcgtggacccctgagttgagtctgcatgcttctcttgtccatggagcatcactttgggaatgagtgctttaatctctttgcctactgcatggaggtaatagttatcaactttttttgtattttggctttgcatcccccaaaatgtgaacctattgtgtttgattatgcatacaccacagagagagagagagagagagagagagagagagagagagagagatacataatagttgctacaaattgatatattctatcttgaagggaagatcattaacactcaaggagttcgcccatcagtggtgatgcacacctttaattcagcacttgagaggcagaggcaggaggatttctgagttcgaggccagcctggtctacagagtgagttccaggacagccagggctacacagagaaaccctgtctcgaaacgccaaaaagaaaaaagactcgaggagttcaaaagggagtcttattagactcaggaagcccctgaaaactccacagatgtgccatgcccccataaagactacctagggacattcttgagccagccaagctgcctggaagaggcagagagcagccagtctttgatcttccctaacctgtcaagtatgtggtgcagtgaaccatagcatcccagctttcatgaactatcatccatgctggggctttggtgatgcagctgccattgagtcaggcctgatcctatacgtaatcccttgcccatactcctgtaagtaacctcaataaaaccctttgcttcagtaagtaggacttcggtgatatttgtacttgtgcatatatatatatatatatgtgtgtgtgtgtgtgtgtgtgtgtgtgtgtgtgtgtgtgtgtatatatgcaaagctgtttgaacttactaaacaggtaggtagaaaggatatgttatgtacttttgtacatggaagtagcctgaaaggctgttgaaatgagcactgaacaaaactgactgagtacatctgtgagagtcataaaaattattgattatatatgaatggaactggtaatagtatttattgactgctattacagtcttaaggctgtgggcccacctatcaaggtccctcttccaacagccaatacatagccttaaggttataatagagatgtcctttaatttacatttgtcgagaaatgcatgggtgaactaactgtctttctttctttctctctctctttcttcctttctttcttttttctttctttctttttttcttctttctttcaaacattttctttctgtgtagccctcacttgtctggaacttgctgtgtagaccaggctaaccttaaactcatagagatctgcttcagcctcccaactgttgggactgaaggcagaagccacatgcctgacatgggttatcattatatcaagccattttataagtgctaaagacttatgccaacttttataattcatgtgagaacatttatgtgtcacataaacattttactacattaatgttatacctctggaaaatttagtcaaagaaggagctaaaggtcagcttttcaagcacacaattttctatatattatatttagttaccacttaaagatgaggtggatcgaaatagctatagatttcaagagtgtccgggaacaaatatcatttgagcaaagttgtgattagtactgtgacttttgtcacttggaacagcttcacatttgtcatttaacttgtaacgtaccttgtaaagacacaaaagcccgcgaagacctggaatgaagcttggtgaaagagacctttccttgcatttaccacgcccagcatggcataaaaaccaaaaccaaaaaaaaaaaaattaaaaaaccaaacaaagaattcgactatgccctctgtttcttattcggtggtttgctaataaattaatagctaacctgatgtccctattgtgcttgttcaacctggtgtttactcagtagtccaaagttcaaagttctctttccttacctgtggcctagaagctgctttaagctgctttctaattctttacttgtttaaggtctgaagtttccagttctggctgtgtttctaagcagggccacagccttcagaagtagcttccccaaagcagaataatgggccctactccctcctttttgacctatgttttctgcgaattaattttttttctcatctccgtttgtatgttcaccaaccacattcctgtgaatccaggtgacctcatttatgagtggtaacctctctcttgggttcctgtctaccaccttctcagtcagtgaggcctcctctgtaaagttccctaagagcttgcacccttgtttgaaacagacccaccagctcaagtattgtttggaagtcctcctgaacactctgcagaggaaggcattgtccatttctgtagctggcaaccactctggcaggcactctttctatatacttagttggtgaggagaatgtctttggaagaggatgagtctggagaaagttaaacaccattaagaggtagtcatggtagctagagcttgtaatcctaatactcaggagacaaatgcaggattatagcaaattcaatgtaatctttggctacattgtgatttttctggtcagtgggccgccatagaaagaccctgatttttcatgtgtatatatgcaaagagacaccatttaaagttgttggccaaaggacccagatatagctctctcttgtgagactatgccggagcctagcaaacacagaagtggatgatcacagtcagctattggatgggtcacacggcccccaatggaggagctagagaaattacccaaggagctgaagggatctgcaaccctataggtggaacaacaatatgaactaaccagtaccccggagctcttgatgtatcaaaagatggcctagtcggccatcactgcaaagagaggcccattggacttgcaaactttatatgtcccagtacaggggaatgccagggccaaaaagggggagtgggtgggtaggggattgggggtgggtgggtatgggggacctttgggatagcattgaaaatgtaaacgaggaaaatacctaattaaaaaaaaagttgttgaccatacctcattgatagcctagagaaagtatgctttgtcccttcaaagggacagtggcaactggaaagctgaacagagcaggtaaggaagtctgttctttaagattcaagacaacacaaggattatatgtgaagaatgcagtgtgttgtgttttataaaactaaaaaaaaaaaaaagaaagaatatgtatggtggatgtatagtcaggtgtgggggaaggggctgcctttgtgggcccatgctgaggcaccctttactcctgagggaccagccacatatattcaggttatgggaaggggaattgagggagtagagacagagaaaggaagagagagagggagagagagagagagagagagagagagagagagagagagagagagagaagcagaccatgagccaatggagggggggaggggaatgggggacagagaggagagggagcaggaacaaggggtcagagcaatagcaagaaggcaagaaagaagagtatagtgaggagtccggcatctattgccaggtaactgtggggcagagcctagaccaaaaaaagaagaagaagaagaagaagaagaagaagaagaagaagaagaagaagaagaagaagaagaagcagcagctagcacagtgtgtgaccctaatggggatgccagtgtgggtaacctgatgaatgtttgtccaggtacagttgagcaattgttaacattaagctatctgtatatttcatgtatgtggtacattcagaaaagtccattgttacccttctctctctctctctctctctctctctctttctattctatcttttttgttgtttccttttttgttataggatgggggcagtttcaagatagggtgttttctatgtaactctggccatcttagaacttgctgtgtaggcaagactggtctcaaactcacagagatccacctgcctctgcctcctgagtgatgccaccacccaatactatttaaaaattttttggccgggcgtggtggcgcatgcctttaatcccagcacttgggaggcagaggcaggcggatttctgagttcgaggccagcctggactacagagtgagttccaggacagccagggctgcacagagaaaccctgtctcgaaaaaccaaaaaaaaaaaaaaaaaaaaaaaaaaaaaaaaaaaaaaaaaaaatttttgaagcttcacaaattcttttctacataatttagaatgcaaaacatgactttcaagttgcacacaattacataattttctaaaaattaagatgcgccaggcgtggtggcgcacgcctttaatcccagcactcaggaggcagaagcagatggattttttagttcaagaccagcctggtctacaaagtgaactccaggacagccagagctatacagagaaacactgtctcaaaaaaaccaaaataaataaataaataaaatttaagaaaatgcaggttgaggtagaagttagctcatagtaggcagtgttagcattctgtctaagctctaccccacagttacctggcaatagccaggtaggcctgacccactataaaaggggttacttgccccctccttgtcctcttacacttctcttgctctttctctgcttcccttcatccctctttccccatccccgcctcccccgcctccacatgctcatagctggcctctactcctctacttctcttctcttcttctcttctcttctcttctcttctcttctcttctcttctcttctcttctcttctcttctcttctctcctctcctctcctctcctctcctctcctctcctctcctctcctctcctcttctctctctctctctctctctctctctccccctctgactttctctgcctctactaccctcttaactccactccccatgccctaaataaactctattctacactataccatcgtgtctctggtccctcagggagaagggatgccttggcatgggcctgctgagacatccccttcccccacacctcaccacacccccatagaacaaaatcccccttctctttatctttttataaacacatcaggcagtaagaaaaagagcctacggtgaaaactacaaattattctgtgtgttaccgagggaatggatattaaggataaaaggcaatgtaagggttaaaatagcagatctagaagcaccaagaagagacaaagaatgagagagccaaataggtcagagaagaaacaaaggggctctaagaagcaagaccagtgacaaaagctggttagcagttagcttagcttttttgagtcctgtccccttagggaagcaagaacatgctaggtagtattacacattatattactgcttttttgtttgtttgtttggttggttggttggtttggtttggtttggtttggtttggtttggtttggtttggtttggtttggtttttcgagacagggtttctctgtgtagctctggctgtcctagaactcactttgtagaccaggctggcctggaactcagaaatctgactgcctctgcctccctagtgctgggattaaaggcatgcaccaccacgcacggctatattactgcttttaatgcatcatctctaatggagtaattataatcgactaagttgtaaataaggatagcttctaacaaccccctgccctttcaggaaagagaccccagaccatcctttagtagacaaagagaaaaccataaacactgcagctgcttttgtggcaagtgagagagcaatgaaaacataattaacagccgtggaacacctgcaaggtcaaaggtagcaacgtcagcagacagtcaaggacagcaatgaaaacagccagagagctttactataattatcagcaagacacctgcaaagtcacaaggtagggatgttgaccaagtaaaaaacagctagcagatagtcaactaagataagtcaactaaaataatcaactaagccagagacagagagggggctggggtgggggggacttatacccatcctgactgagcatgacacaaacatcaaatgatcagctgttgcttagaccaggcagatatgcataggcatgtagatcctctattgtctcagtcccttatgtggcataaggtcttctatatggacttgtccaggagctccttcgtcaggtacttacagtgacctaccaggagccaagaaagacccctatgaagctttctgagagttttcatgataggaggagagagaaagggggttaagcctctgatcaagtcatcacaaacacaagatagggatggaaaaccaggtccttcttccaggaagagggatgctaaaagacctgagaccagtaagagtaactctcccagataggcctctggcacacatgttccagtaatggaaagataatgcttgaacaaaagaaagcagatgcctctggtggagggtttcgagatatgggacaacaaacagatcaattgcatctatttctgggacccaactgtatacttagcccaagttgatgtctttctagtgaagagagctccaataatagtagtaatagtagtagtagtggtagtagtagtggtagtagtagtagcagcagcagtagtaatagaaatagggctgataataggagctgaaatgttttgaccacatgacaagtcaaaagtatctcaactctcattccaggggttccaacttctgaccccatcaggcattcatatgaatgtggtaaacagacatatatgaacacaaaatacctgtacatgtaaattttattaaacatttttttaaagttgaccgtacatagtaagaaagttacagaagatttgagtgtggatttgttgggaaaagaaattacttttttggctaactctagggatacgtatttctctctatcttaactagaacaggaacatacgtctctatatatgactggaattacaggcttaccatataaaaatttctgactctgcatttgcattcctttcaacttttcttgttttcaggaactattccttcacttcaagctcattgactcttatgctgggatgaattttttttctaactctcagactaaaaacaaacaaacaaacaagtaaattccaagtaaagaagtggctttcttaccctatggaaacataaaagaacttggatggataaatatgtgtgtcctgaattttcttcccatggatttcctccacatcatgagtttggtgattatgacacactatactatgaagggacgatctcactgaaggactccaagacaaatagtgaagggcagtgttccaggaaactgtcaggaccttccatgtaacgccccagaattcattcattcatcactggaatgtatggcctatatgtatatgaggtttatttggggaaataaagagagatcctggagcagggcagtggtgactcatgcctttaatcccagcacttgggaggcagaggcaggcagagttctgagttcgaggctagcctggtctacggagtgagttccaggacagccagggctatgcagagaaaccctgtcttgactgtctcaaaaaaaccaagagagagacagagagagtgagcagagagagacagagagagagagagacaaagagacaaagagacagagaaagagaccctgggcacatttttctgttaggttagttacctagcctagccctacctctaaaccagagattcctaaagatgactcaaaaaagcacaagtagtaacatttaaaatttaaaataggcaataggggttgaaactgggtgtgttaagatgagtatctggctggaatgtatcaactattctgtcactattcggacactattattcttcttctgtggcagggaggccagaagcttgagtcatctcattcttgctcgggtggacaccagacaccttagggatgggctgcaggattgtcctctaagatgagatgacttagggaaacctgtgttctaaatctgtgttccttttgttcccaaccatagagagactgagccaaagaatgtctcctcactatttaaccttctctgacaggaagcaattagacctcctgtgtcctaagatggggagatgagctgaaattcttgcaaaatgtatctgaatgtaagaaggtctgtgcctctgaggagatgtgacaccatactagcctgagcattgccagaagagatatatggtgaaccataactttaaaatcttaccaaccaattggagcaggactaacactttggttcaattggctatccctttcactaccacacattgtcagtataccaagaccaaactcaatgatttcatccaaaccagaaatgtcattgaccctcaggtttctatggattccactagagttcaagaggggcccgtaattcagtttaatgctagaaaccaaatagcaacaggatttgggtcagcaatctaccataaataaaaatgtagaatggataaaggatgcattctaaactcaacaaagacttttaaattacacaaggatacctatacttctgaaaggtatagcagatcatctggaggtcatcagggaaacggcatggtaaattggctagccctcactgtgatatcagcacataaaggagaatctgtgatgatggcaggtagtaacgttgtacttcatttctgaaaagaaaacttctgatagcaccatacaaaggctcttcgggaactacctactatgctcaataggttaactgaaattatgacaggggaaaggttcctccatcttgtctcagttgtaaccatctgtgttccaggaattcaaggtcaaaatcgcagctaactgaatgttgttggcttctgttaatcagattgcttgctttactttcccctgcatctgtcaaccaagatgtggttttcctgtaatctctgcctttaaaaactcccataagagccagacatggtggcgcatgcctttaatcccagtacttgggaggcagaggcaggcagatttctgagttcgaggccagccttaaaaaagaaaaaaaaaaacaaaaacaaaaacaaaaaaaaaacaaaaaaccaaaaaccaaaaaccaaaaaccaaaaaccaaaacctcccccataaaatgcatttgaggctgtttttctctccacgcaatttctagatggcttaatacagacttttaattcagacttcggtcatgtgagtagtctttgggtctctacctatcaacaaatagaatcccactgagatctctttgagactttttttttgttgttgttgttttttcaagacacggtttctctgtatagtcctggctgtcctggaactcactttgtagaccaggttggcctcgaactcagaaatccgcctgcctctgcctcccaagtgctgtgatcaaaggcgtgcgccaccaccgcccggctctttgagactcttaccagtgtgaccaactgtagatcttggcacaggctgtgaaccagagtacctgcaggttcagaacctagggggttcaaaacctgaaactttccagggctctggaagagaagatcttggtgaatcctacattcctgtctaaagttccttcagtaagaatcatctagtctgtcacctcctgaggtcctgaggtaagtctggttaaagtaccttctgtttaggacataaaggaaaggccagctgtagccactgatcgactgtccagactccatgtgagacatgactggattctccaatctgttcgggtataagaatgtgtggtggtcaacccatggttgtctttaatgtgcttctctttctatatgtttctgcccgttctattttcctagtggatttctctggtgtgaaaatcacccagccccatatcacctccgcttaagacctgtgcagtcttggtacggacctgaatcctttggctctatcaagttgcccagagaaaccaaaaacctccacctgtcccactcccacagtgttcctttgttgcttgactactgctcagtgggtcccagtccctgtgtggaggcatctaagtggaatgcataaagagttggagaaagttccccaagcatctcactccatctgctccccacctcctgctctaggcagccccaagtaaagggaaagtgccacagggctgtgcagggatcaggtggggtgagggttgtccaccccttccgcttccatgatttatgtcttttaaccaatgatctgatcattagaaaactcaaaagccatctttccctgaaaaggagtaggaaaaaaaaaactgttcccaagccagatggggctactgctgccagacagactgtataggatgtgttttcccttctgtccaacacaaagtagactttaaacacttttcactagtttgtccatgaaacaaaagacattacacaggcccacctgtcaaagaactgagtggttcctgctagtctaatgaacaaaaagcccacatgttaactaaggccaggaacttctaacagcaactcacacagctgagctctcctccaaggaccaccagaattctggttgtctaatacccatgtgacttagtaccaggccctactcctggactacctttgagaatggtttgagagacctactaccatcagtcctaataccctcttgcctggtgatgaccatgatgttcatccatgactgtcatgagatgacatccccctgaaagatctcaatacagagctctacactaataggactgacttcgtttaagatgaaactagtcattacaggccctccagttctccataaaggctttctgtttaggacataaaggaaaggccagctgcagccactgatctagtgtccagactctgtgtgagacatgattggattcttcagactatctgagagaccaaactaacctccaagtccaccaccagtttccccttattcaagcccaataatactgcctgggtcaagtaggtagccaaaggggccttaacaggtgattctctattcctctgaccatgaaggtagttggtattacaccatggatccactacacccaggtgaagaaagccaaagccacagatgatgatgccaagtggactgtcctcagactctggacccattaaaattaaaattaattaaattaattaaaatttcaagcccttctactccctgccccctctgtagaccaggctggccacgaattcagaagtccgcctgcctctgcctcccaagtgctgggattaaaggcgtgcgccaccactgcctggcctcttcttgagtcttgtgtttggtataaatatagggtcctgattcagctcccactgccctcagacttggacctgggaactgaggaagacagggatactgtacgttagaagtagtgtgactacagacccactgacttaatacggactatcaatttggactttggttgtgctgagtggcctttggctctaccccacagcaaaattcaagaataaatgacccattttcaaatcttaggaagcaatgtcttggaaaggaaaaaaggataaggatttcagtcctaaaattccttgttctagttctagggatatagttagatatcccgtgaccccatacatacaatggttgttgatgcaaagactatgtaactgacaaaacattgccatcatctcaaaacaggattattgatgaaatcctcaaaactggcaagtcaggcaatgctaactcaatctgaggacaagaatgaaaatgtattgtaaatgggggaaattgttggaaatttaatgtactggggttttttctatcaaagggtgaaataagacaaaattctagttaaaaaaaattgtaaagaagccacttggcagaaactcagattcctccagggtcaacacttcttgaaataaaatatgtgctcaaaaccggagcaagcataatggctcctgcctttaatcccagcacttgggagacaaaagcaggtggactgctgaatttgaggcaagtctggtctgccgatttagttcagggattgccagggctagtaatgagaccttgcttggaaaataactcaaaaaacccaaaatgtgcttgacttcttcctccctggagaccgtgctgctctgtgtaggctaactataagaatgtgagcacgccaaggacgccacatgaaaccccacagaatcatcaaacagggctcatagaggctcacagagagattgaacagacaatcagggagcctgcatgagtctgacctaggcccctctctatgtgttatagttgtgtaatttggtgttcttgtggaacccctaagagtgggaataggggtgtctctgactcctttgcctgcttctgggacccttttcctcccacatgattgcctggtctagcctggtctatccttaatgtaaatgtttgtgcctagtcttctaatgtgtcatgccatgcttggttgagatccccggggaggcctgatcttttctgaaggaaaaggaggagtggatctggaggagaggggagatgtgggaaggactctctcggagaggagggaagggaaactcaggagaggagggaaggatgtgctatgaaaagaagaagaagaacaaataaaagaaaaagaaaagaaaagaaaaattttaaagatgcaaaagaccaaaaacaaacaaacaaacaaacaaaaacaagcaaacaaaaacaataacgaatgtaagcactcctagggaagcacacagcaccctttaccacagtaatgcagcacagtaatgcagtaatacagcaatacagcaatacagcaatacagcaatacagcaatacagcaatacagcaatacagcacagacgcctgcatcccactgcacatgctttcctgctgcacagggcaggactgtggacccttcagcagaaataaaatgttttgctttgctgaaatactttggaataatatggtcattttcttgcatgctgagagctgattgtgggtttggtttgctattctctgatgactagtgttggtgagaccctgccccacccccaccccccacccccacacacacacctgccatcacttgagaaatgtctactcagccccttcactaattttttaattaacttgcttgttttgttctggtttggagttagctgtccagcttccttaaatattctggatattaactcctgagcaaaaatgttctggccaatttggaatctggccaactccttagcaaagtatgttctggatattaactccttagcaaatatattctctgccagtttggaatctggttttgagtttgttggctgtgcaaaagcaagacaactcctgccactccaatgcacaaaccctaatccctgccaagaaccaatgttgagttttttcctaggagttttaagagttccgatcttagccaggcctagttgcataatctatagccccagctactcatgaggccaaggcaggaggctttcctgggctatagaactagatgaaggatgtctgggaaacatagtaagaaggtgtcttaaaattttaagttaaagaatgtaactccaaccagatatgcttacacacacctttaattctaacacccagacaggggcaggcagatctctgaattccaggccagtctggtatacagaggcagttccagaacagacatggctacatagaaaactttgtctcacgcaaacaaataaagaaataaaaaagggttgtaattctttggtagaatgtttgtctaagatgtgtgaagccctgagtttaatgaccagcacaacaaagactgtaagttgtacatctagtattttgcgtttgcttctctgtatgtttaccaagctcctaataacgaggccttaaatatataggcaaatgctggaccatagctccagccctgtttttgcttttctgattgtatgtgggctagggtggcccaaaactcatggtaattctactgcctaattgcccctggaactggatttactggcagaagctgccatgcctggttgtatattttggaatatgatacaccctgtgccctgttacttatgctccccttctgggagacactttctctcggtctgctctccatcccaagagtaaatgaaacattctatttatattttgcccttagcagggacctaaaagtaatcaggaaactgttctatattattctgagatctagtctgtatacccaaggaaagggtggtatttggtgtgtgatgggaggaaaggtttaaaaatgattctttggggaaaagttatatggcccagtcgctaacagagagatctggggaagttattctctattcctttctttcttcacctgtaaaatgagataatattcacctgcgttataggctgagaatttgtgctagccagttttatgtcaacttgacagaggctaggagaggagggagcctcaggggagaaaaatcctccctctgtatggaatttttgaaaatagtaactgatgatggagggcccagcccattatgggtaattccatccctggaatggtggtcctgatttctgtaagcagactgagaaagtcatgaagaataattcagcaagcagcacccctccttggtctctgcatcatctcctccctccaaatttctgccctatttgagtttctttcctgacttactttgatgatgaacagcgatgtggaagcataagccaaatagaccatcgcctctccaagttgctttgattatgatgtttcatcatagcaatagtaaccttaggttacatagaattaaacagtattatttaatctgttgttataaaaatcacatctgaaaaggaataagaactagtttattttggagttattttaaataaccatggccaagaaaacaaatttaggttacatgaaatttcatgttctgatgtggaagcagtttcatgaaggtttatagctttacagagcagagaaagttataaaactcaaggcaagtttaaaatatattgatggataaactagtaaggcaagtaaaacaagatggaaggtgataattataggcctaaaatacaagctggtagcaagcattcttagctactgaatggcagaagctagtgtcctgctaagggaatacaatggcctggcaaacaataggcattccagaaagctaaaactagcccaagacaaagtaattaacctctgaaccagcaaaattccaatctctccacaggcctgaaatcccaattcacccatcatcagtctctgcagacacagacacctcttccagaagagttttgttcatagagcaagacacagcttcttctcgggaatttttatgcacagataatatgaacacagacatctaagcacccactaaatagtactggtgatttaatgatttggtgcatgtgataaacaatattctccttgaaaataccagctcatctcctctctgggtgctaacaacagcctccactagcagcaggcttacactcagagagcgattttgggacactcatatttccgtgcaaacatcccaggtcacagatattttctggttttgactatagaaaaggagccactggcatcctgacagtaataagttgcagcggggaaggaagtgcgctcattcaaaatgcacctgcgctgcattaggccagggattacaaactgagctgggctaagcagtgtcgtgtttacaccgactcgggcagctggctcagcatgaggctctggatagacacaaaggctgcttgttgcttgtcccttggcagctgcagcggtggcagcagcagcagcagcggcggcggagcaggaaccacactgcttaactagcaagaaacctgtctcagagcctctcctctgaaagaaaggtgaagaacagtatgtgccaagacagtatttcttttacttttaaaacgccatctccaaatatccttgcataaaccaggtagcacaagaaaacactattttctctgtggtggcttctccttcctgactacggggtcctctgtattgctggggctggcctgtaagcccctaggtaggcccactgctcctcatgtcctggttgtccagctccacatctgggtttctggatgataactgtctccctgccccagcccctaacacacatactcaaaggcagcatctccacccagcagacagcctcctggcctgtgctggtgacagagccagagcaggcatgaagatgaagccttttgtcacatccctgcctaggaagaaaagctaggtctggctggggcgggggaggggcaggccttctgcctgtgccatgaggcttttcagtactgctgcctaagagcaggagcacaatacaggaggggagacaggcctgaggggagggaccctctgaggagacactgcagccaccagcagaggccagagcaggagctgcagctggcagctccccagccaggctgaatgcagctgccctgcctcccttaaaggggaagcctccacacagaggagagctagggattaaagctttcatcagctcatcagagagaggcactggtaccagggaaggaaggagtgggatgtggaacaagagcaaaggcacaggcagccagcgccatgtacaccaaggtggtgcacttttccaaagcctagggatgaaaaggagaaacagagctcttgcttctgaggcatggaaacacacaccacacacacacacacaacacacaaacacacaacacacacacaaacacacaacacacacacacacacacaacacacagctaaaccctgagagaagctccctggactataggatgtccccagacagctgacacaggaaagttctttcctctgtgtaccacagcaggggcacatggcagtcttcctcccttgtgggctatgggaactttgagcacctgatgaaactttaatttttttcaaaacctattttttttaaagatttatttattattatatgtaagtacactgtagctgtcttcagacacaccagaaaagggagtcagatcttgttacggatggttgtgagccaccatgtggttgctgggatttgaactatggaccttcggaagagcagtctggtgctcttacccactgagccatctcaccagccctcaaaacccatttttaataatggatggatcttagatgctttaacctcccttgtagactactacccaccagaagtactgggaaagaaagcatacagggaagcagacttttttaaaaggttctctggagcaactcctgtctgtgttgtctggaaatcggcagtttagtttacaggttagcagtggcagcccgatccactcgcagtgcaaacacttcactgcaaacacaaacaggtatctgcagtgatggcactacctagcagagacagccaggcctcagcattggcacaagtcagcaggagggaccttaagggacaccagaagttcccagctgtgcctctctcagggaagcggaaaatcatccaagactggagacccacacacattgtgcatttcacagctagctctataagcagtccaagcttggcctcaatcactgtccatcgagtcctagttataccctccaaacatcacgtgtcctccacaggtcttgcctcagtatgcgcacctgtctcagctgacattacttggccaatcagcccgagtccattgaagcaacaagaaactgcagcacactatgggaagtttttcggtatgtttctctctatggagtactgacaaatgcagctcaactacacaatgtaagctgggccaagaaatgagtgttgttagcaaagaatccttttttttttttggttttttgagacagggtttctctgtgtagccttggctgtcctggaactcactttgtagaccaggctggccttgaactcagaaatcggcctgtccctgcctcccaagtgctgggattaaaggcatgcgccaccacacccggctcaaagaatccttcatcatgtgtcctctagcatgcttgctttagcagaacatcctttctcctgtttctgcttcagctaaacattccttcacatgtttgcccctagcaaaacaccattcaaccaagtttccaatgaacccttaagtttccacttcaacctgatgtatgccaggtctgttcagactgaagctgtgacagagatgtactctgctccttagcgagtttctacagacattggaggagcttggaaggatggtcaaatcagctgccctgataactagaggcctaccttgtatatggacccagaccctgcatgcacaatatctaccagttgggcttcagtattacctgcgttcaagttgcacactctgggtgcatgaaggctcacattcagtgcgttccatcagatttaatagcaagagggcagaagggacaaatgggagatagaagagagtagtaaggaacgctggtcagatggtgaagagtcttggtccttatggaagttccaagtggagactttgaggttcgctttttagaaatgtctacatgacattcatggaaaggcagaatttttttttgataaataaaattattgcatttaatgttattttcttaaaaacccaaatcatcatatcccttaatgttgtaccaaacaatgccagttcaaatgatagaaaatgtatgtcaacagtacctgaaaacaaaattaagaagggtataaagccctacctacagtttgtctaatttacatcaagcggtcatggaaacaaatgatcattaaaattattttataattatgtacaatgaacaaaagcatagtaagtagcagggtacttttccaccataaaattatttacagccctttgttcatctagaaacactagcttgagaggtacttgtcaggtatattcctcttgaaataacttctctacagcaaacaattgtcttctatttggaacacattgaagaaaataattgtctcattatttttgtgttttgagtcttgattcctaatagttcaaggtattatgggagaatcctggtgtcctggatagctcaataacaaactgagatctagcagagtgtttgtattctgagaatactgtccagtgcatgcaaatgcttgcgtgtaggctgtgcgcccagactcacaaagcctgttaggaaagcttcacacagactttgctttgctccttctttatagggcgttgcgcttccttctccgttttcttcctttgttgttctgctgtctcttctctccgtctgaaattttctgctgcttcaggacttcttctgcttgccaggctgcgtcttcttcctcttcccatgcactggtattttcttgccacgtatctaagtcacctaattttgaagactgatgaataaaaggcctatcttgtgcagctgccaatctactggaaaaacctgtgctaccatctgggacaccaaaattcaatggttctctcttcttaatgacaattttctgagttttctgtatagttggagttatggcctcgaagtagtcaggttccagttgctccaaagagttctgctgtgttgccacaatcccattccctccttcgatgcactagtgggctcatcttcatcccaggaagtccactcctccaggtctgtctgcttagggacagacgaataatcaactgtggtgggcaaagttatttgatctccacttaatttccttcctctgccagatctgcacattaatctctttaggaatgagaacactattgctaggcaagtacaaactttaaagaaccgaaactgagtgatggccatggtgaaaaccagaacttgcccctccccctccccgcccgcctgcgctgcggaggctcagagctgccgcgggccgtgcgcgctcagcggctgcctgcctagagctcgcgctcagccatcttagtcccagctccactcattcaaagccgggcgcgcacacgcgctccgtcgcagccaccgtggccgccccttctccaaaattccccagatttttttttttttttttttttttttttgcaaaacccagtagttaagtacatatcaagaaattagaaactaaacttagtaaagaaatgagggctgtatatgaagctcagtgcagaaggccctggatgctaccctctactcgcagcgtggaaacagacacacgcacaccagcgcgaacacatgcaggaaggaaagagtatcttgaagtgtgaattggctcttggtgaacttctggtttctgaagaagggaagcatcccattaagtgcagccaatgcatagtacctatttgctcttaaatattctgtatttggtctaggtgttatagcacaaggaagtaaaaatcaatcttaaatgctcagcaattatagttaaacttaatgcagtgagatttaaaaaaaaaaatctccggagcagtggtggcgcatgtctttaatcccagcacttgggaggcagaagcaggcaaatttctgagtttgagaccagcctggtctacagagtgagttccgggacagctagggctacacagagaaaccctgtctccaaaaaacaaaacaaacaaacaaacaaaaatatctcctactaacagtagttagctagcatgaacagcccagaaattaatgctcatgtgtgtggtcgggttatttttaactggagtgtcaagtcaactgaattttgggaaaagaatagtcttttcaaaacaaagggttcaggcaaggctttatgtgcgtgtacaaaagagtgattttttaaaaaatgatcccaaggaccagggagatggcttggtaggtaaagtgcttgccatacaaaaacaagctcctggattcaaatccccagcatccacgtaagggcacacatttgtagtaatattgctgaagatgcagagacaggtggattccagagtcactggccaatcagtgtcactgaagctgtgaacttcaacattaaattagaatgtcatcaaggaagacatttgataccaatctctatcgacttgagtctagcctctatatacacatgcatacagataggaacacacacacatatcacaaacacatacactcaaatagaaggaactaagaatgcattaaagatcaaaacagaccagttaaaatcataagtgctaacaagaatatacattagacttggcaatgactttaaaacaaagttcagaaaagcaagagaatgggaatttaaggtcatctttactacagcatggactatattaagcccagttcctaaaaacaaaaacaaaaaacaaaacaaaaaaacccatttttatacaaatagccatgtgcagtggtgtgtgtatagctataatcccaccactttgaacacaggggcagaagaattgcataccagttctaggcagccagggttacattcccagactctgtctcaaaacaaaacagcaacacaaaatgatgaaaatgccctggaaatggtggcatttaatcccagtactcaggaaacagggttcgaggccagcctggtgtagacagcaagttccaggacagccagagctacacagtgaaactctgtctctaaaaccaaaacaaaacaaacaaaaaatatcacaaagccaggcggtggtggcgcatacctttagtcccagtacttgggaggcagaggcaggcagatttctgagttccaggacagccagggctacacagagaaaccctgtctccaaaaaacaaaacaaaaacaacaaaaaaaccacaaaaatgtaacctatagttgagacaaagtatttgatagctgtattattgataaatactaacaaaaatatatgaatggctataaatcaatgaaagagctctgaaaagagatcagattgaagaagcagttggttgtggttgcacacacctgtagtcctagagcactggtgtctaatgcaggagaacctcaagttccaggctagtctggaacatatcctaagcaccaggccagcttgaagctgcagagcaaaaatactgcctcaaaaaaaattgtaatcagatttccatactgtaccaatatattattcttcaaaataaatgaacatacaagtttcaaaacaggaatttcatactccctaacaaaaataaccttggataaatgtgattttccagaggagcacatattttgatgcttaatcggaaatcagtattccttttctgtttgatcggttttttgtttgtttgttttggttttgttttttccagacagagtttctctgtgtagccctggctgtcctggaactcactctgtagaccagactggcctcgaactcagaaatcggcctgcctctgcctcccaagtgctgggattaaaggcgtgcgccaccaatgcccggctgttgttttgttgttgttgttgttgttttttaaagatgtatttactttttacgagcattggtgttttgcctgactgaatgtatgcctgtgtgaaggtgtcagatcccatagaactgccattacaggcacttgtaagaggccgtgtgggtgctgggccccggtcctccagaaagttgccaatgctcttattcactaattcatttctccagcccagaaatcgttatttctaatgcatcatcacacgagatccaggatccagttcaatgcggatgtataaatggaggcaaacagaatcttaggctgaaaagtgattttttttaaagttttatttattctctcatgccatccatctgaaccgcagctttcgctccctctagtccttccggttcctccccgccaataacccccactgtgaagcatgaaatttttgaaaaggttggcaaaggccctgaacatcgcaacttgtgattggcttagatagcagtttcctaagactccctatagaccttcctcattgggtcctcacattgcctcgcctactttgtatctagtttcttttctttcctttgcctagtggcttgtgttttagcctccttgctcctccctactctgcttgcttcctctctgccctttctggtcttagggcctgaacagtaccccctcccggtcacctttctgttctgttctgcttggcttcctgctcagagccccgagtctcctcaactcaccgagtctcctcaactcaccatcttcggtcttcgcttcgaggtctccttggccccacgctctagcctcgcctcacctacgtaagatctcgcttcctaatttgtctgccctctacaggtttgtgctttgcccaagccgccatggaaagtgacttagtgggcccagagggcagccaggatgtttccagagtggagggaacagaggtcttgtcacccccactccaagcctctcctgtaattgccactgcgaacttagctgccaggcagggcaggtctacccagagcaggagagcacaaggcggttcaggattcaggcttcctggcccagagagggtggagtccaaccaggaagagcgtctcattcctctctcacagatgatcccatacatctcctgttttatttgcaaaggctacttaatagatgcggcgaccattacagaatgtcttcatagtttctgtaaaagctgcatcgtaaaacattttgaacacagcaacagatgtcctaagtgcaaccttatagtgcaccaggccaaacctcataaaaacttgaggatggatccacaattacaaagcatagtatacaaattagtggcaggtctagaggaaaatgaaaaaaagcagaggcgtgaatttaataaagaacattgtctgggaccaccagaacccgctgctgatccacagccaggccattcaagtgaagagaacactaaggaagttgtggaatagtgtcttagtttatgtgatctggtatgtctttagtactggagtctatgggtactaatgcatacactgaacatgttaagcactgaaaatccacgtttatctgagtctcaggaaatgaaaccactggacagagagaaacatttctcaaaaaaacaacaagctttgctgcagcttgtcagttgctgaaggactttcaaactcaaccagtacagtgtacagtagtgaatatgaggatacaggatgaggatacaggatagtctgctgccttttgttaaggtctcctctcagagtgacttgctacagctatcatgaaaggacagaaagtaagaaggcctctgcagaactgaatcttaccgaagagtcctagaaaacatagaatcattataagctgtactgtttctggcatacctgttttctgcaccagaaatcctagcgtttataggattgttacagcttagaacaatgggattaaaaaaaacattgacttttaaatttccttacgattccaagaactgtgaagttgaatgttgcacctcatcatcactgttgacagtttgctcttttgttgagcccattctctttcaagctgattgaggttctgctgtctgcggtggcttcagtggtcttccttctggaaaacaacatcccaggggtccaaagccagtcttcgttaaattgcaaagtaaactcacaaagactgactttttctttttttttttttaactacgtttgtatgttgacaccatattttgaagttacctgttttttgaaagtaacagcactcctgaagagatgttattccgttctaaaaggtaggaattactgtagtacaggaagaaattgtctctagtagggtgtatgacttgagccataaaccttcagacttaacatgtcttaagataagaggcagtctttgtgagatatatatatatagttaaatatgtattaacttaattgtatatgttatacacacactgtagttactacccatgttactggtgtagtgagatcacacaagatccccatagaataattgctgataccttgtgatggtaatggtgccaccttctgaaatagcaaagttccagttaactcataagtttctatattgtttctccagcaagtcacttttactgatgtaatttttgctgtctgtttccctattatttttgtcattgggatttaaaaataaggctgtttgtaagctaactttaatgtagaaacttctatttaaaaaatttttttctttgccaaaaattttacattttgatatttctaaacgatatcctacagactcttgtttcgcaaacattttaaatcctgtgttggaaactttaaacactggacaaacaatggtaattgtaaaggatttgggaactgtctggacatggtggcacatgcccgtaatcttagtacttgggcaaggagaggggaagatcaggagttcaaagtctccttcacctacatagggcatgggcaatattggcagctgttgaaacctttaaggagtgtgggggtgggggctggagcattacgagtgtgagcctgaaagtggattgtgagaccctgtcctctatttctggccatgagttgaacgatcccttacaatgccttgctaccttaccactgtcccagatcaacaggaacaagcagccaatggtgtagccgtatggaaactgtgagccaaatgaacattttctctttttagattgattatctcagttatttattcttataatagaaagctaatcaacaacattattttatatttaaaattgatgttgagaactgtagtggattattataattgcatattgttgtaatttcctgttaatacaaattggcctctctcaggaactactaatggtagagacattttctactcctctgtgtctctttccaggttttcagtgtgatgcatccagatttgtataacacactaatgcccacatccctctgggagatctcacaagcgcttgcctcacaggaagacctccatagctggcatccactgtgccaatagccacaagaaggacatcttagttacagcatggtcccgttgttgctttggcatccatgccagcatagttgttttcgccatttgggtttttgttttatttctgttgtttttgtctgttttcccctgcccactggttgagcagatgttggcctgtggttgttgtcttttctcttacatttaatataaactgattctgttacttcatgcatgtgcctctgtgtgttttgtactgcctcatttggtgttgtgctggactggcatgctgcaaagaaattctctgggtaaaggcttttttaaatagtggctatcttggtaaaaataaagtggacccaaaagtcctaagaatatctcccatatccacaaactctggagctccatcaaggcagggctccagggacacacctcaagttcaacttcgaggaaaagaaatccttgggatatcaaaaatgtgtatgccctttgagctgagagacagagcatgtgctcacgttcattttggcttagtgtctggccctctcacttggctagcactgtgtgggaaggctctcgggtttgctgatgtgtctgtgttgctgtctactgctgcctgttgtattgccttggtcaagtccccagtccccagctacattgatgggtctgaaaatgtctgatttctttctaggacccaatttgctgggttcatattccagtaagagtgaccacatgtcgtattggtctttttttggtttgtttttgttttttaagatttatttatttatttattatatgtgagtacactgtagctgtcttcagacactccggaagagggtattagatctttttacggatggttgtgagccaccatgtggttgctgggatttgaactcaggaccttcggaagagtagtcagtgctcttaaccactgagccatctcaccagtttccttttttttttttttttttttttttgtttgggtttttttgagtcagggtttctcggtgcaggtctggctgtcctgctggaactcactcggtagacaccagtctggcctcaaactcagaaatctgactgcctctgcctcccaagtactggaattaaaagtgtgagtcaccactgcccggtgtattggtcattttgtaacagagctgctagtagagttaagtcgagtctgttcccgaggttctgtctgtgctgtggtggcttgttccagaggcacaggggaaagggtgagcctgtaaggagcggccaggtagataatgggctggtgatttcaggatcctgtgcatccactaacttggtgaggggttagatgaggctgggattttcagcctggcaaagtaggagagtcacattcactaggaagacaaggatcctcactggccaatgtggcaatgtcttcccttgatgactccccgcccctccaataccctcctccgtgtcaaaagacttaatgctttgaatataaaggcagaaattcctcatcttcacccctgccccagggagcctgaagttccaggatggaaaagctgggtagcgtgctcagtgctcaggatgcctaaggaccttgtacaaggatcctgccctctgtgctttagggatggatggcttggcctaaaccaggtgagatccactgggtccctctggagaaggcagagactgcctcacattggatacagtgggacccacaaatggaagccatctatcactggtggagatcctggaaaccctacgaagttgttaggtgaatgtctcaagacaggaaacattcttctaagctacctagatatagaaactactcaagaaaaatccttacaaggataggtgaaggaaatacttttttttaagttctgtcattttggaggaagggtcacaggaaggctcctggatgtaggtaccaggtcccttcgtttcctgcttttcctcttaggaaccaggaagatcagggataatctgcaacttttaggccaaaagtcagcagtgggggatgggcacacacaaggaacttctggtgttctctgaacctaacgaagggggaaaaaatcctgctgctattgtggcctcatattcatgggcacaaaagaggaagctcaaactttgattactgaggaaacaccacttgcagggagcacagagctcctccggattacttaccattctataagcaaaccccgagagaggacaaataggaaggttaaatcatagctacatgccttttaacactagcacatgatacactatgtgcccataaaatagaagtaaactgtcaaaaaattacatacttcgattcaaaattggtttgagtactttccctggtttcagtttgaagaaccaaaccaagcaacgaacccacgatttaaatctgatctggcaaaagctgaggcttgcaggccttcagtttagtaatacatgccctacacctcacacttcaccaattgaaccagcaactgatgcatcgctacacaatcataacccagttccaggccctgactataggctaatgttctactttgtttgtgagataagtgtctctccttatgctagggcatcaatcagttggtttgactggctcttgtctccagcttctccagtgctgggaaggcaaacatgcatttgtgtgtggatattaggtgaaggaggctcaggggcggttaggccaaaatggaaagcagtctctggttgctccttgatccttttcctcaagggtgttggatctgatacagtttgctaactgaagggtgggcaggaccaacaatggagagatctgcctgcttttgcctccctggtgctagattaaaggccaccactaagccagtttgaactgcttgctctttttcccccttttcttccttccttccttccttccttccttccttccttccttttcttcttggttgttcaagacaaggttttttctgggtaaccttggccatcacggaactcactctgtagaccaggctggccttggtccacctgcctctgcttcctgagtgctgagattaaaggagtgtgccaccaccgcccagcctgctctagtgagaagcagaggggagcagggttctttttgggttgatttttttgtttcgctttctttctttctttctttctttctttctttctttctttctttctttctttctttctctctctctctctctctctctctctctctctctctctctctctctttctttctctctttctttgtctacttgtttgttgttgttttttttaaagatttatttattgtatatgagtacactgtcactgtttcagacacaccagaagaaagcattggatccaattacagatggttgtgagccaccatgtggttgctgggaattgaactcgggacctctggaagagcagtctgtgcttaagttggccacgatacaaataagctaggagatcttaagagtgttctgtatctgtctctgaactgcctggttggcggatatggagattattgctcaaatgggcaatctctctctctccctcccttcccccctctctctgtctctctctgtctctctgtctctgtctctctctcacacactcacacacaaacaccattatcatcatcatctcccaccacgcccgtactcctgcttgctcctatgtagtgtagcagtttactgggaacaaaaacaatccctcaaaggagaagggggccttcaggtatctcttgcgaatagaaatgtaacaagactctcaaaggcttctgcccagctttgcagaagtagtaaacaacagctggaagacaaaggagactgactagcccagctgtctagaggctagttgaattttctccaagtttttcagagagctccaaagataagcttttcctgactaaaatgcttttggcttggtatctgtaactgaccactcatccatactcctggtggtgaccccaattaaagctcacagctgcttcaccaagttggactttggtgcagttgttacttttgtctgccataggctccctttcttgggtcaagtagatgagtatgtgtttcattccccccaaaagtgtgtcacaacaaacttcagtgccccaacagggacctgacaggagcaaagatgagttggagaggagcaattgtgtgatcttgtttatataaagcaagccatacaattgaggccgagcaagctgcgggtggggtggatggggggtcatctaaggaggaaattccacaaagcagtctcctcactggaaaccaccacaacctcaatccatacggtgtgcgctagcgtgcctttttgctactgcattggtttcatggttcctgctaggagaggtgagatgtgtaactaaggcagagccatgggtggagtgtctgtgagagggatcccaggaaggcagtcttcaactctctggtttggggtagcatccctgcctgatgagtggaatctaacacttgaatgtggagatgcctgagaacagcgaaaggtttcaaatgttagtctttgagagtagcgcagaagggcagagagtatcagtagccagctatggaagttgctgggctgctgctatgagataaaaatgctttggggcaggaactgcagcccagcaggaacctgttggtgtaaaggaggaattataagaaaggcagccacagctagcatcctccatgttggccactgatttagcaggtgaatttgataaaagaaaggatgagttagaggtgttggtttgccacttattatagctggggaaagtacaggttatgtgagtgctgaagggcccttcctgggatccaagaacttggaacccaaggaaagaacagaagcatgagaaagaagaaaagaaagagactttggtaaaaatgagaaaagacacataggtctaacctttaatagaaaagatgagaaaatctgtgatccaacttggagggggacatggtttaatgatagtcccatacaaaagtacctttgatactagggactactcatccctgaagagcttgaattgaagaaggctttaaaataagcaatgaaagatcctgtcgctgcctggctcatgacactgggtcacactggagtagacgggatcagtctgactgctgtggagacagataactacccctctccttaagacaggggtttcgtaacctgaaattcggatgcatggtgcacagagacaacagaaaaaaagaacagtagttacctgagtctgggggtagaccaatttggcaaagattgcttaatggagagctgcaatttgaaataaattgaaaaagtttttgataaagactaatggtaatagctgtacaatagattgaataactctaaatgacaatttaatcttatatgtatgtcacaatgctaagcactttatacaaaaagacaagttatagactaggagaacatatttgagaagacaaattttagattacagacttacatctagaacttgcaaagaacacttaaaacttaatatagtcaagtcttttgcttactaggaattcagttctaatcaccaaaaatattatgtctagatgacatatatgatatatatgtgtgcatgtaatatatatatatatatatgtatatatatcttttattatcaaaaactgtcaatgatcatctaagccttccttcagtatgtcaatctttctgttgtcagaggaccttgcttcgggtggctggacagaatagaggttgttgaaagttgaaatgactgtgacaatgtctcaacatacaaacactgacagtgagtgggtggcacaggcctctaatctcagctacttaggatgctgatataggagggttgcaaactcaagatcaacttggctacagagagagtttaaggccagcctgagcagcctagtgacatcctgcatcaaaataagaaggagccaaaaaataaaataaatccatcataatgttggaaatcagtcataatgttggagacaataggcagagacaggcagatttctgagttcgaggccagcctggtctacagagtgagttccaggacagccagggctacacagagataccctgtctcgaaaaacaaaaacaaaaacattaggccttttctttagcccatgcttcaccatctttgatcattcaacactgttaaatcataggttttgaatattttggagaacagcttcctcctctggatccatctggcagtagggtttctctcagtcttctctcccatagcaggcagacatatagaaatatcagggcttgtcattgtgctggaggtcatcctcatagttaaggaacagcatcaaaaaggtcacatccaatcagaataatcacggctgcccattcaaagccatagactcaattacaactgtaggtgctaaccagcaccccttttgtttgtttccaaattttatctttgcacggtcataatgagatgagttaaatctattataatcttagtagtgatgctgttcatctctggaccttgtgaactcaacttttgtttaagttttatctcctcttatttacagttgttccacactcaaatggttctatatcaatcaaactccatctatctgggttctccaatcatcctccagtgcctagaagttggcaagaatggagaccctaaacccctttacaaccctcggatcagctggaagcaggtagattgactcaatgtccatattctaaataattttagagtcttgagtctttctttgttttggtgtttggtttttcgagacagggtttctctgggtagccctggctgtcctggaactcactctgtagaccaggctggccttgaactcagaaatccacctgcctctgcctcctacgtgctgggattaaaggcatgcaccaccactacccggcgagtcttaagtcttgatgggagaatgttaggtagctaaacagacattagcggggttgaaggctattgaggaagaacctctctcacatagaactttccttcttcaaattttctgaaactgtcccaaggccccattgatgaatatgccactcttgaccagagaaagagagagagagagagagagagagcccctaggatgatgacatgcccatcatgccctttccctgactgtaagcaatacttgctttacaatgagagtactggagggtttgagaacaaaaagttgggtgggtaggaaagggggagtggatctaaatgaagtgtggagtagacggtgaatatgatcaaaatacattacaagaaaaaaaaactaataaagaaaaaaaagagggagggaagagtgttagagactcagaagtgaaagcaaagcggtttattatttgcatcagcctggaatgtcaggtgggctggcccagtgcatagagaaatgtatatactctaacccatgacctttcctccccttccttccttccttccttccttccttccttccttccttccttccttccttccttccttccttccttcctccctccctccctccctccctccctccctccctccctcccttccttccttccttccttccttcttcctacattccttccttccttcctttcatagtctggacaatcttaacatttcatctaggcattatctttccccacgtcacattaatttatttatctgtttgtttgtttatttattttcttaacaaaacgggttcatctctatgtattacctcttgtttatttggtccagcttatcaggtgcatagctgtgcaggcgagtttagctatgagtaatttaattctctacacttctaggtggggtgaagggtgtgtggtgaagcagactttgggggttaggaaattggtagcctagtatgcattagcaaggactaatgttttctgctcatttgtagctggacttaaagcttaatgctcctttgaaatgaaccatcttatagtattctaaaacctatctgacagaaacagaagtcaggaatgttagtcagggccatgctacttcacaaagttcttccaataactagttctcctacattcttgctatctccaccctcatagctgactcagcttataggccccaggctaacaggctcctttcatccccactgccagccaggatgagacagcaagcatgtgcattactgaagtgctggagaaccttacttttcctctaaaatgatagaagggaccctcattctgccatgtgggccatatcttttcacaaagccccaccacgttgccctgtccatcaatgacattaataatctcttaaagaaatagggggaaaggggaccagagttagcatgaaaggtaaaggtctgtgtgtccttcacagtacagattatcaggggaatgatctggaaaagagcagcaaccctagccaggaggcctccagtcactctcagaaaaacagtcaggtggggtctacagaagaaggagaaagaggggatgaaacagatgaccaggatatgtctgcaaaagagtggggggactgccattattttccagactccatgaagctaccaagccatctgaatagaagctgccctctttgaaacatctgcaccaaatcaaggacatttggaggtgacgctccagatgtttgacagctggcagccaactaccagcgtgatgatgatttcgaaagtattgagcaagagcaggtcaggatgcacatagtgcttgcaggccaggctacagccagcatgcttagggggagcccttcagccagcagcggagagctcctgcaaatgctatcttatgctgattctttctgccttgactcttcttatgttatgtttaccttcataaatcactgtagtcattattttaacaactttatcttgaaatattcatgtgaaaactttgttaattcatacctccatgaatttattctcttatggatttgagtgaatacttaacttctgtgttccaatacattctaactttaaattttgtgccttcatctttccatttgacaaactcattttagcattttatttgttttaactaataatgagaaattagacctgttgttttcacataaacttctggaacccttttccccttcagttcagtatttgtttcatttattataagttctgtctttgttttatccaaaaaaaaaaaaaaaaagcatttaggcctggcccgcaggcagtgatgcagtggtccctttttggagtcagtttcttttctgctaatcttgttatttagtcctcactccccagggcaccctactgccttctactgccccccaccagtgcctcccaccccccctactgcctcctactggccccccatcgcccccccactgtctcctactggcccctactgcctcctattgctcccccattccctcccccctatctgaggacagaaggccttgctagcaaactctctgctgacctaaactcccaacccctactaatcttcgcttttagttgctcatatcatttttcattattcctatcatttgcaaactgtcactctcctatattcagattgttttttgattacttatttatttttattttatgtatattgctgttttgagtgcatatgtctgtatgagggtgtcctatcaggacacagaagttacagacagttgtaagctgccatgtggatgaacctgggccctctggaagagcagccagttctctgaaccgctgagtcatctctccagactgttttcttttaccatgatgatttacatttttacatgttgtgatagaaaattattagtatgagacaaatacaatatagccatcttgcccacaccacccagattttcccaaggaatcacattgcccataaataaagcacagtacaagccaggcagtgatggtgtacacctttaatcccagcacttgggaggcagaggcaggtggatttctgagtttgaggccagccttgtctacagagggagttccaggacagccagggatacacagagaaactgtgtctcgaaaaaccaaaaaataaataataaataaataataaataaatacataaagcacagtacccaagccatattaacattgcatgttatcacatgcatagacttgtgtgatgaacaccataatggaaaggcagcatcaatacaatgacattcttgttgctattcctttatttatttatttatttatttatttttttaaagatttatttatttattatatgtaagtactgtcttcagacaccagaagagggagtcagatctcattacagatggttgtgagccaccatgtggttgctgggatttgaactctggaccttcggaagagcagtcgggtgctcttacccactgagccatctcgccagcccctgagccatctcgccagccccgctattcctttacacacagcttttctttgcaatttgtgatagatgaaaacagtgtattctaatattaggataaaaataatatgaaaggcccggagagatggccctacaggtaaaggcgtatggtacccttgaacacatataaaggtgaaaggagagaactgaccccagacacacagcacagcaatgcacacaaacactaataataacggtagtagtaataataataataataataataataataataataataataataaattaaacatcaaagaatgaaatctataacatttaaagaatattgtcatgaaaatgatggtacagtccacaaaatggggctttaaaaaagtctttgccaactgtacattcgacagaagattaacatcgacaggttctttataaagaaattaaacccttcaaaaccccacaaataattcagccagtaaatgaaactgaacacacacaagtggccaatatctgaaaatatgtccatcaccctaagccatcagggaaatgcaagtttgggagtacatttgagattgtggaaaggagataaagccaacaaggatgtagggaaagggaaacttttattttactggtacagtgactctggaagttggtatggagagtcttgaaacaattcaaagaagaattatcaagtcaggcatatgcgtgcaatcccagcacccaggaaacagaggtaggctgatttttgtgagtttgaggcatatatgtattcaaatgctgtaatgaaacccacttctttgtttgctaattaaaaaataataatttccaagcgacttcatgaatagggaggtagcaaaatgtatttataatattgttatatacgcaataatgtgaatattctgcttttgatactaaatcacagtttgcaaggctgtggtggtttgtgcttagaaggggaaggcaggatcatagaaattctgggagctcaaatttaaggccagccagggatactcaaaaccctgttcaaacaccaccaccagcaccaccactgctgccagcaccagcgccaccatcgacatcacagctgccgccgccaccattaacaccaccaccagaaaaaaagctaatgcatgctaattccatgaattattttattttacatgcaattgtgttaattccttaatacttggaagcaagttgtatgctattaaaaaataataataaactgaggagttgcctaagcaaaacaactcaaagtagaaatactgtataaagaagaacacattaatactctgtaagaaacatcaaagagtagaaaagacattccttgggtaccaaaaacaaagaaatcaaagctactatacggaagccaaggcaagaaatgtggccaaacaaacacaaaggggagtttaaggaggaagggctgcctgcgggaagccaagacatctatccaaaaagaaagtgattattcacagccacaatagcaccacaaaaaagggccttttcttatcactacctctgctgtgtactgaatttatcccagtccaagagatgaaaagatgctacctaccactacatcttgcctttccttagtatcctttttgttcactgacttttatctttttgcctaattacctatttttattagttaataataacaacaggaacaggagagaataattgagaatttcatgattttttaaataattttattcagactatacaattgaaaagtaagaattgcagtggtttttttttctttttctttttttttttttttggtctgttttgtttttagagacaaagttcctctgtttcgtcctggttgttgtggaactcactctttagactaggttggcctagaacttaattagtttaagaccataattacaaaggctttattgtttgtatgcaaagcaagttaggttccttctggatagtttgtggtatatattatcataaaagtttttattttaaacttatatatataaatatatctttaaggataatggtacctaagtattaaaaattcctataaccagtcatggtggagtaattcatcccagcactcagaaggcagagcaacttttcaatgtatagtctgaataaaattattaaaaaaaccatttgattctcaatttctcttgaaattttctcctgttcctggtccttttggcagataaggcatattttagacaaaacagtattattatgaagactagtcatagaacaaaggagttcagaaagacaaggttaaaaagtctatactgagcccgtgaggtggctcagtgagtcagggtgccggccatacaaacctaacagtcagatctgtatctctcacccaaaagctatgaggatgatgcgcaatgagatcggtatttccatgccacctaataacacagtagccatttctcagttgatgcttcaatgaaggaataatttaaattatcaagtttaattatgaattacatttctcttttgtcttcttttgcccctcctggggattgaacctaggacctccttcatgttggtaaaagcactctgccactgaatcacaaacattaacagtgtgtattacagtttgtgatccatgggaggagtgaggaaaatagcaacacagtggctttatggcaggagtgtagtgatagagcacttgcatagtgtgttccatcaacctttgccaggaaaactagtaaaattaaccggagattggaggaagctgattccaaccttgatgggtgatcttggggatgagccaagattttagtagaagaaataacctcagatgtagtgaaaatatcaaaaggtagaattgagaaaggagtctaaagctgttagttaattgttggtgttagagggatggctcagcagataagagcaccggctgtgcaagaagaggtcccaggttaggttctcagcacccacgtggcagctaacaactgcctggaactccagttccaggggatctgacacctttttccagcttctgaaagcataggcacacagatgcacacacacacactcagaaagagagaaacaaacaaataagcaaataaataaataaaaatgaatggatgaggagtttgctttcttatatgaaaaagaacgagtttcttgtgatggcttttaaatgttgtaaagatgctgtaaacactgcttccatccatcacaaagaattgaaaatattacattcacttggtagcacagtagcagtgcttgaaagcactaaatgcaattaaagttcaatcatagcactacggagaaatcaacagatgtagagagtcaacggatgcagcaagctatcttgttttatttcaacaaatttactcagctaccccatcattgagggggcagggatgtcaaaggaggcgccaagtcagaatgtccttcccaatggcacagtatgcatagtctaaggtaatgctttaggccagccacagaaagcaaagggtgttaatggtcctgtagtgagggggatgtgtactgcaagacggccccaagttgattgacattaccaaattgggttaaagggcgctttaaactttgtagtttgggctggtgcgggtgcttaaaaaaaaatcccaaatacattttgagataaagggacagctggaaaattctgcaggacaatgagcatagtgacttctgtggtgagtcactgctcagtggcttctaggccctgggtgcctgggaagctgctgagtgagtccttgcccacagctctctctgtttagggctttgctctctgaaaaggacacactcctcactaatgggacagaaggttttcagcctcttttgctttcagcttcttcgtttaggtaaaaggaacagagggacatattttatagaaaaggtggtgttaggggcgtaggtggcactgagatcattctggccacatcctgctgaattacaactcattattgggtggcagtctctgaatcagaggctggtatctgacttcacacatcagagggatagtgcttgtgtgttgcatggtggtttaggtaaatctggatagcacgtggagtagaaagggacctatggatataaaaatcaaaatggttattaacatggtaacagctcctataagcaagtcgattcaggatgagttctaaaaccatttgttccagaatttgataactacttccagtttttgttttgttttggtttttgttttgttttttttttttttttgttgttgttgttgtttgtttttttttttttggtttttttttttttggtttttcaagatagggtttctctgtatagccctggctgtcctggaactcactttgtagaccaggctggcctcgaactcagaaatccacctgcctctgcctcccgagtgctgggattaaaggcatgtgccaccatgcctggctccaggttttgaaatatggtcagctttgttgctgcaacctaacctagccagaatgacttacagaaaagctctgctgctttcccccaaagaggccaagtccccttttctctggccaagagatttaggcctcttctgttttggaggagtgactcctgccaagaaccctacctgataccagaccctttcttcgtttttacttttaaatacttattttatgcacatgagtgttttgcctgcatgcatgcataagtactgtgcatgagtgtctggtgcttgcacaggccagaagagtgagttgggtcccctagaacttactgcattggagttacaggcagttgttggtgctgggaaccaagattctctgggaaagcaacaagtgctcttaaccaactgcgcaggcccaatcctagattcttgttaaacactgagaaattgcatcaaggatttcctgtatggcttgcgataaggaatagtagtgtacaaagtacatagttcctgtgccaacatctgtcattaaccctaagattataaggaaagagtaggaaataatcacgtgtcttctattccacatgcaaccagtcaaagctctggttattgggagcaacatttatgttgggggctagggaataggtatagcagtggaaagtttcggtctagctgatgaggagacacaggtcaaggggaagaagccctgtttgaacagctggtgaggctaagggagagaaaacggagtaactgggagggtgccgattggggggggggggtttagatcattctaccaaactgaaagggtaagggtgccctcccatcaagtgttgaagtgtgatgctgtgaaagagacagggtaccacaaccttcaggatcaggtctgccacttggtggccttctccaggttagctggcctgcaagcttctgtctgattcttcctttttgttccgcccatctcactggagcaatactgggattatagatgtttcactgtgctccgggggacaaattcgggttgtctgagtagcactgcaagtgtttttactcagtggcccaactctctggtctggacctaggatcttgaactgggaggtctgagctgtctgcttttctgcaaactagcgtaggtgtactacaggaggagctggctggctggaggtcctacatcaaaacaaggtgagcgatgagacagactcctgaaagcacacacaccagggaaaattgtacaaactttaaatctttttctctcccttcccttcccttcccttcccttcccttcccttctcttttctttatagaaaatttattgcaactctccaaccgcacattactttttctcttcaacatcttgctccgcagcttccttcacgctttttgcttgggcattggcacaggccatgtgaagactggcaaaagccttagagttctcttctgtgtcgacgctggccttttcctttttgtacacattccgggtgggcatcacaggtcctgtcagttgggtggccaatttaagttcttcaacagaactgtctcccttcttcagagaaggcttcctgggggaaagtatgagctttgagcagtactcctttaggcgctgcatggtagcttgcagcgattcagtggatttgtttcgcctccttgggtccacagagatgccgatggtatgatttcttgtggttaccagtcaccctgagttcctccaggctgaagcccctgacagctcagaccttggtgtgtttttttttttgtttttgtttttgttttttcgagagagggtttctctgtgtagccctggctatcctggaactcactctgtagaccaggctggcctcgaactcagaaatccaccagcctctgcctcccaagtgctgggattaaaggcgtgcgccaccacggcccgacttggtgtggtatctaactgtagggcacttcacggtgggcctgaccggaccggatgcgggacgagtggcaatgcagcacgcttttgcctgccgagccctgagtctgcggatcttgcatggcagctggttgaaccaagtgtctactagctgctgccaatgtttgtggaagtggggcttcatgatcacgccattccggctggacgccatggctgcctcctgtacaggagaacgacagggcggagaggtcttccttctttctctatcctccctgacaaactttctctctctccctctccctccccccccccctctttggtttttcaagatagggtttctctgtgtagccctggctgtcctggaactcactttgtagaccaggctggccttgagctcagaaattcgcctgcttctgcctccctagtgctgggattaaaggcgtgcgccaccactgcctggcttgacaaactctcctgacacatggtatcatgtccttaagctggccttgaactcagtatgtagatgcttatgaccttgaacttctgatcctcatgcctctgtttcgtgctaggattacaggccagtgtccccaaacacgatttgagaatttattttcacagagatgcaatcatcatacaaccggtaaacggtgatctttcaacaaaagatggtgaaacaattgaccggatttcaaaacaaaacaaaacactcattcattatacaaatattcattctaatgaatactagatttaaaggtactaaagaaactttatatgacatctatggagaaaaaaaaaggaaaacttgtgcgttgtttggaaatggctttgaaggaacagtcctagttctagctggtaaatctggacttctccacatgcatcagcgaccaggagactattttacacacagagttaaatgcagaagtgactagacatttcaggaccagttttcctatggtcagaggaaagttaaaaaaacaaacaaacaaacaatactacctccattacagagtcctccgtgtattcatgtttattttcataaataacacagatagctacacactgagataattaaccaggcaccagcattactatatacatgtattttctaggttgctgcttagtccagaagcaatgaagcttcaccggttaaaggacactcaatactcacacaataccttctaaatctgtttttcaacaggaagtacccaggctcctcatagaaatggctagggatagacatagtgaaggcgaactacaaggtaagcatcactatcttagagtacacgaagcactggggaggtgatggcagcaagagccattctggactacataagaccctatcacacaggagaaaaaaagtagagattgtaaagggtaaattgataattaggggctggagagatggctcattgctgttccagaggacctgccttcattcccagcatccacatggcagctcacaatttcagttccagtggatctgaccacctcttcactaagacatcaagagaagtggctgggacatgtgttaacaagcacaagaatagtcgggcagtggtggagcaacgactttaatcccatcacttgggaggcagaagcagatggatttctgagttcaaggccatcgtggtctacagagtgagttccaggacagccaggactgcacagagaaaccctgtctcaaaacaccaaaccaaccaaccaaacaaacaaacaaacaaaagcaagcacaagaatcaaaagcataaaaaatgaggaaatttgttctcccttctgggattttcttcatttatgtgctcagggcacacagaaggttgaggagaacactgggaaatgacccacggaccacacattttaggcataaacagtgtggggagagttggaaaaaaaatccacacagaagcacacacacaaagaagccctacttagatcttcctctcctatacagaacaaaatccttattccatacaagaagggcaacaaatactacagcctctggccagttgtgaaagccatctgaccctggtgaatggacaggaaggggttaaataaaaacagttccggggaaaaggtagaaataaatactgtgtctaaatttgggaaagggagcagggggcaggagtagggagcaggaatccaccacacaatccaagactgagatataataaaccagcagatgaggcacactccctgccagtcacaaggctaaggagcactacagtacagcactacaacataaggcttactacagaagtaaagacagttacgtggaacaagagctctgagacacagcgcaaaaaccacctgagagtaatggagttatttaggaaaccagaggcaatggctccctgtcaaacaccctacaaagatgtatcactctgagaaaagcaagccgcagcttcatctccagagcagtggggcagaggcttaggccaggatgaaggaagacagagcccagaaagacatcctcaagaaaactgattaggaacacaatgggggaaggcaaaagcctaagagtggaaagcaacaaacaggaaattctaactggctgaaggtactaaactagtctaactcatcacttagtctgccttatgtgaaagctcactagtaggaagtgacagattgaataagagaaaaagcttgcaaattaaaggtagctatccacgagtctcatttaatttagaagcttacatgtaaccctattttccactggggagcaggaaagtggaggatgtttacactttaagtgggagtagtaaagtcgtttttatgagaattcaataaacttaagagaaacatagaatgggctaggactttctgttgagcctataaaccagtgagtggtactcgaactaccatagatgacaacccctttggcaaacctctatctccgaaaatatttacattgtgattcataatagtagcaaaactacagctatgaagtggcaatggaaataattttatggttgagaatcaccgcaacatgaggaactgcattaaagggccacgagcagcattaggaaggctgagaaccactgctctagacagacatctgcttgtgtactatttttatggaatttttatttttttctagacagggtttctctgtgtagccctggctgtcctggaactcactctgtagaccaaactggcctcgaactcagagatctgcctgcctctgcctcccaagtgctgggattaaaggcatgtgccaccactgcccggcttttatggactattaaatgaaacctaaggctaaggcagtgatgtagggagggcaaaggtgtatctaggaatatatagtttccaatttccccttgtggcacaaatcagtttaatgaaaacctaaggaaaagccagggatggcggtgcatgcactctgagttcagggacagcctggtctacagagtgagatccaggacagccagggctacactatctctaaggggaaaagaaaagaaaagaaaagaaaagaaaagaaaagaaaagaagggaaggggaaggggaaagggaaagggaaaggaaaagaagggaagggaagggaagagaagagaagagaagagaagagaagagaagagaagagaagagaagagaagagaagagaactcaagaaagagaatagaggtgattattatattcctcagcaggtctgagctgtataagcagaccaaagtatactttcctagtatcttctactctcatttgataaagcaagcataataaagcactgtgtttgggagtggccattcttggactccttcataggcttcaaacactacctttacaaaaggatacaaatttatttgagtgacattttagaacaacattaccaagagccatgggagagatgggggagatagttcaatgggcaaagtgcttgcatgaagacttgagttcagatcccaagcacatctttagaagctgagcatgacggcacagtgcagcactcatggatagaaacagatggctcccacaggcttgctggccagctccaggttcagtaagaaaccctgtgtatcagtcacttttctgatattgtgataaaacgtggccaaggcaacttagataaaaaaagagtttatttgggcttacagttccatgacagagtggaggtggcaggcagcaggcatggtagctggagcagccaagttgaacatcttgaactgcaagcataaggcagagacagtgaagtcaaaatggtgcaaatttttaaactctcaaagcctgcctccagtgacataattccatcaacaagactgtgcctccctagcctttccaaacaatggcagcaactagggaccaagtatcccaatgcctgagactatggtggatatctcgttcaaactaccacaccctatctcaaaaacataaggtaggttgactcagatcttccagaggatgtaggttcattcacagcacctataagacacctataaacaggtgttttacaactgtcaacagctccatcccaggggatccaggtccctcttcctgcctcccctgaacacctagcacacaagtggtatgcagacatatgtcagcactctggacgtagaggcaggtagatttctgtgagttctggggccagcatggtctacagagtaagtttcaggacagccaaggctacacagagagaccctgtctcaaagaaaacaattaaaactaaaaaacaaagtgaagcacaatagaggaagacacccaaagtcaacctctaatcacatgacgtgtgtacgtgtgtgcatccgtgtgcgagaaaacagacacacacagacacacacacacacaatgcctgggacaaaaacaatagattagcacataattaatacaaagtgatagttcaatatgataacaagaaccagagattaaattcaatgctgttctcccctaagaatgacaccgaggatgtagtataaataataagcactttagttgaagtcctgtcaaatcgtgaattgaaaaaaggagaccataccaatcaactctaaaacataggaagacacactactcaaagtcgctctgatgaacagagtatagttcatcaagcctatatccctgcattctggaaactaagaaagaagattgcagggggcagaggcaggcagatttctgagtttgaggccagcctggtctgcagagtgagttccaggacagccggggctacacagagaaaccctctctttaaaaaaccgggaaaaaaaaagattgctgggagtttagggcaggcctaggctaccagtgatttctaggctagcctgtactgcagagtaagactttgtctcagaaacaccctccaataaaagaaatcactgcaacatattaattacataaaatattcaagtttcaataaagacggaaagatatacaaggaagtgggagggtaggatctgtataaggaacagaaactttagtgatagaaaatgacttaaaaaacacagttcacacctgacacctgggactgctaatgacaacaggagctagaaagtgctcaaaccatttagggtatgaaccttgaaagaaatagctctgagttctatccttggccagaaactgggacatgcccttgctcctgtcttgtcaggagaccagaaatgcaaaaacaaccactatcataagagaaagagaaaataatttatgaatatcaacagttaaagaagagcccccagagcaccccacattaagtctggcaatggtgatactaacgtttgctaaatgaagacaaaaggaagtaatttcttgggaaacagaagttgtcatcgttgggttataagacaaagataaggagaagcacattgatctactgtagaaaccaaatccaggacaataaaggcctccatgatgtgtgacacatcatcaggcttcgtctccagtcaacaccagctcaggcaggcctcccgctcttgtttgtaggagaaagaggaggctaagtcgggaggagcacggcaagtttggggctcactcaacacggtgcatgccacatagcctacagggtaaaactgtgtctttaaaacagaaacaagcaagcaaagaaacaacaaaatcctcagctttcctaaaacaactgaaaagcaaaagccacttcccaactatcggtccagattaccctgataatcaaaaccaaagagaaagcaaacaagtaaacgaaaatcaaaaatacaaatcagtattgcttgggtacaaagactataacaaaatattacatttaattaaataccacctgaaaggaattcgagtttgggagatatgtcagtgtgaaatgttttctgtgtacatatgagggcttagttaggatcccagccaccgtttttttttttcttttttctttttgtaggcagtatgacagcatctgtcaattcagcgctgggaggtagagatggcaagatcatagggcttataggaagagaacatactacaggcaaatgtagtttattgccagaccccaggggaggttaaacgttttaaaagtcaatccataatgagctaggcacggtggaccatacctgaaatcctagcccctgggaagcagggcagaaggattgggacttcaagggtaagctagactacaagcaagactttatcttaaatttgaattagttaagtaactaattcattaactaattaatgattttaacaacctgggctgagagcataggtcagtgggagagtgcttgcatagcacattccagttttaaccccaccatcgctgaagtgactgtggtaacgccatcttgtcctgattttaccctgactccactttgttcaggtacctttttcagcccctaatcccctaaaaagtccaacccaccttgacagcatatttggaactttctaaggccctgaccacagcacaggtgaataatcaacctaacagctgaatgtataatcaagagaaacgttaccaggtttccccggacccatgcctgccaatgacatcattgcagtttttgcctttacaaatgcagtacctttgagcttcagtgctcttcagagcaggagtctgcactctgttccaagctaataaaggactctaatttggtcttacattcatagtactttgaaactttcttgcttgggctataactgcaaaataaattttccataccaacagttgaaagaagaaacacaatcataccaacagatacatttttaaaaatccaatatttatttattatctatgtgtatgcattattttgtgtgtatatgtgttcataagtatgtacatgtgtgtgtgtgtgtgtgtgtgtggagttcagagagtgatgttgtgtcatttccaatcactctcaatgttagtttttgggacaaggtctcaaagaacttagagtccattatttggctaggctggctggccagcgagctacagtaatccacttgtgcctgataccctcactcaactggagtcacaattgcctgtcaccatgcccagtgttgatgtactcaagtgttcctgatcctgctccaagcacattacaacagagccatttccccagcgccctcccaatcaatgttcttccatgataaaaactgtcagtggacaaggctagagagatggttcagtgatcagtatcgattcctggtcttgcagaggactgggtttcagctcccagcagtcatatccagtagctataactgatgctgaaggtcctctgctacacattcatcatcttgctactgaggtactataggcgcgatgctttttctgtggttatataaatgaaactttataaaatttaatttataaaaaaaattcaaaattcaatttctagtggtttgttgctaatatattagctcactaattttgacttgagaaagaatcttatctaacccagactggcaccaaactcacaagttagctgaatctagtcttgaactccttcatgatcctcctgcttctatctctgaagtattattaactccaattacaggggctctgataccctctgctctctataggctcctccatgcatgtaatgtatataaactcatgcaaacacacggaaatgtaactaaatacatcttttttaaaaattctcagctaggggctgagaaatggctcagtggttaagggcactggttgctcttccagaggatccaggttcaattcccagaaaccacatggtcgtttacaactgtctgtaactccagttccatgggatctgacaccctcacacagacatccatgcaggcaaaacaccaatgtatataaaataaaaataaattatatatatatatatattctcagctaataggaatagaaagaaatgctaccacaacaaagcatatgcacatacaaatcatagaaatgcttaaagtctgaaacttttctcttaagattatagtaaaacaagcccggcagtggtggcgcaagcctttaacccagcactcgggaggcagaggcaggcggatttctgagttcaaggccagcctggttgacagagtgagttccaggacagccagggatacacagagaaaccctgtcttgaattttaaaaaatcaaatcaagattataataaaacaaagaagacctttactgccagtctaaagcagtggtggttgctgttcatgtagtaatgttttaaagattgggggggggggggaaggggagacaggaaaaatattcagaagaatgatcaaaactgaagccacaaacactaagtagactatcccaaggaaacttaggtgccatggctaatctctacaaggactccctgcctcaaaagaaaataaaaactgtaagggcttagaatgtagctcagtgggagagtactgcctaccatgttccattgtgagttccatccctaatactggggagggggtgtttagaaaaaaagaaaaccaaaagaatatacaaaaggataacatatcaacagtagattgtttcaccaaactggtactatccaaggccagtaataaaaatcagtgtggaaaccgggcagtgtggaaaccaggcgcacgcctgcaatcccagcacttgggaggcagaggcaggtggatttctgagttcgaggccagcctggtctacagagtgagttccaggacaaccagggttacacagaaaaaccttgtctcaaaaaaaccaaaaccaaaaccaaaaaccaaccaaccaaacaaacaaacaaacaaaatcactgtgaaagctgtgtggagcacatctgtaatcctagcacttgggaaatgaagactggagggaggatcaggagttcaaggaaaggctcagctacctggggagtttggggccagcctgagttacagaagatcctatctcaaaataagacaaaaatcaatgtgctaatatgctaaaaataaaccagtataaactggaaatttgtaaagtcttgcttatataacagtaggggggaaagtcactattaaagttctacaacagcaaagtgataaatgtataacaaactactatatgcggaaaactaaaacaaagcaaagcaaagctaaaggggccttaatggaatgtgatgcccccagactgacctacagatgaaaagcaatccaaaactcctagcaaaaaatttatggacactaacttactgtgtcaaaaatttatagatgatttctgctttacagtacagaatgctcagagcttgaaaactcattctagcctggcatgctggtacatacctttagccccagcactcgggaggcagaggcagaggcacaggcaggcagaaacactgtgagtctgaggccagcctggtctacatagtaagttccagaacagccaaggctatgtagtgagaccttgtctcaaagaaataaacaaataatgataaagcaagcaaacaaagagcctgggcacagggagagcgatgccatggagagtccaaaaattcttcataatctctcacgatgaacatcggagaaaaatcccatatgcttaggagggtgcaaccaccttcaaatatattcagccatttcaaaatacataagagtgttctgtactgaacaaggctcctgcttaaaaaaataaactgctttgtcaaggactaaaggagatgggaaaggggacagacatatctgggtacccaattccagcctgaagtttccaacccacagctctctcgtcatcacatctcacttacatggagggggagagataattaggagggtgggcaattgtacttcacaacccaggagcacacaagcagtaaaagacagaataaccagggacattcagaacatgtcaaatcaccacgtatcttactaccacagccctacaggcctatgtactgtagttccttttactggctacatcatacttgactttcaaaaaaacctgagaaatgagggggggagacagacagagagagagagagagagagagagagagagagagagagagaatacaaagcacatgccctttaactgtcaaattgacacagtctacagtcatctgagagactgatcaaatcacactggcctgatgggtgccatcattccctgggtgagtggttccgggatgtataagcaagctagtacgcacaggtgagccagcaagccgtattcctccatggtttcttcttcaagtccctgcttgagtttctgctctgacttccttcagtggtggattaatgatctggaagtacaagccaaataaatcctttcttcctctactttgcctttggtcagtgtgttatatgacaatagaaagaaaagtaaaacaaaacaataaagacaacacagtttaaaattaaaaaatccagcatgtattagtatcagacttaaatacgtactgaatgttggaattattaaactgaaatatttgcctgtttttcagtgtcagttcaatggctgaaagtcaattaatagccataagtttgatggatcaagtctgaagcagaaagattgggaattccaggccagcctaatccacatagcaagaccctgtctcaaaaacacaagaaagaaattgatatgaacacagtctcagagcccttggtgttacccgaagggtggagcagcaggatatttttctcctgagccttacaaaggtcatattgggggagtcacatgtccagtcacatactggagcctaacctgctgggtttcttgccttcaaatctccatagaacttaagtgatggtattgttacatctcagaaaggtcagattcatcactgatgtcctgataaccctctcgttgggaccacacatatggtcttttctcataattggctgactgactttcagtagctgaatcaaagtcctgaaccactgctgtgcagaaagatccatcggcacagtaacgttttttacacaagtggaaataacattctaaatttgagtctcgggcgctatattgtttactcttcaaaagtaccatcagtgtcccaaagaatatagcattcccaagattcaaatatgtgacttcctttgcctgcatgcagaaccatttaaagtgacttatagtgtagccgcccgcgtaatgccctgttcaaagcttcctttgtttatgcagtggcaacagttgccctgtatctataattaataaagattaattgctaatatggactattctggtcttagtaagatcctatgcaaatagaaattattacttttagttttgtttttatttattaaaattttaaatgagatttatttcattttgtgtttgtgcatcacgtgtctggtacccaaggaggtcagaagaggatttggaccacctgggacttgagttacaaaatattgagaactcccatgcaagataccagccatgttagatcctcatgtcacaaaaaaattaagtggagaagctgagcttataatcctagctatttgggaggcagaggcagaaaaatcaagaccagcctgggttattacacataaagtaagagagacaagctgggcatggtggtacaagcttgtaatcccaaagcttggcagctagaaatgggtagtgagggtcgtggacagcctcaactacagaagacttcattaaggggctcaaaaagtgggcttacgaccgcctgtaactcgagttccacaggattctatggcttcttctggcttccataactgtactcatgtgcacattcctacacacacaattagaagcaaatcttaaagtgggaacagatctagatatagttcagtggtagtgtgactgtctagcaccacagtgtcctaggttccacaaccaatactggggggaaagggggaaataagcacaattactaaactaaaaatgatgcttaatctacgggatgacaaaagagtgagccgcaactgtggagaaatatggcaaaacgtcaactctaatattagggtttcattttattctctgtgtttgcatttgtgttaaataggtcataatatataaagctgccgaaatgttttaaaaatagcaaacattcctttgtcaccctcatacatatatgaaaaaaatgagatcatattatcctacaacttgtttttaatgtaacaagctatcatatcatcttttacaccaaagagccaaaatatacagacttttaaaacatcctcctattaatggatacacaggttgtttcttatcacttgccacaagaaaagagctgcatagacatcctcttttaggtatccttatttatatactgatgcttctctttctgaaggattgagccgtgaaagtcagactactgagttccagatattggaacttggtactccatatatatttttatttttctaaatatagctacatcaatgcttccaaatggttgcaacaattcatactttattcagcaatgcctagctaaggtactgaaatgtctttttgaccaagtaagcatctaacaaaagaacacagatcaccctataaggccctattataacagatgctcccagaccacaaatttagtaacatactctggtcctcatttggagtacataaaaagggcatagggcaaaaagcgttattataccataattaatgttaccaataagctagttttatcaactactaagtgttgatgagaaagaactgaggccgtttttcgaggcctctggggagctagaataaacactccattttggagacactcactatccgtcaaaccccaattagacaaaggaaaacaaaaggaaacctcaaaacacgatctctcctaggaatgagcctccccagcctgacaggttcatccgtggaggtccggtgatgtgggcactgatcactcatctattgtgggcggaataggggagaaatccggagtgccagccgccgactactcgtcccgctcggcagaccatgcggtcggagtggtgaccgctgcggcgggtcggcgtggtgaccgctacggcggccatctctctgacagcgcgagacccggcactcaccagggcatgttcattaattggccagtttctccactctccttattaagtcatcctctagctgcctggctaatcccgggaaggacgtatacatgtggacgccgccattttataagttacagaagcctggtggtgccgtgggggggggggggggggggtcgggcgggcggagagcatgcgtcacagccgaacagtccctgtgccgcgcggcgccgcgctgtcaggctgtccctaaatggctgctccagcaacgtgaccgggactgtccgcggtcgcttccgcagatgactgagcgcttgcggttcctctcccggctgcctctgttagcatctttcacgtgctcccgcgtttcttgcccgtctttaatttgttctcttgccaccccctcaccccccaccccccaccctacccccaccgaaattcctttttcttttttgtttctatagaagaccagcttgtgttttgctcccgagatctctttcggagccccttctgtgtttttagctgccagcattgctgtagctgctataactgcaatctacatgtcacagaggctaggtggcaaagtaaaccacaggcctgggtatgtcccctagtttttgataaagacagaattataccttgtcctattcctattggacacctcacagggccgaagctgacaataactcctttggcttttggatgttcacaccaatactggttaccacacaaattagaaaaggatcttgggttatcaataaaggcagagaactacacttccatttaaaaaagaaagaaaaaagttctcattttacctattgcaccacgaggcacaggggcagaagcgagtgctcagtggttaacagtgcttaatgctctagcaaaggatgcaggttcagtccccggcacatacttctctctacacagatctctctacacaggcaaacatgtatacacacacacacacacacacacacacacacacacacacacgaagtaaatgcatgtgtgtgtgtgtatttaagtaaaaccatgttggaaagttgccgaaggggcctcagtgaatatctgcttgaggaaggctttgctaaggcaacctgggacagctgtcatggagccgagggctgtcctctctccagaaggtagcacattttcccttacactggtttccctctttcccaagacagcaaagccctggcttcttttcattccattacaggcagttctttcctgtgcgagctctcctcagctgtagccagaatttgcctgtttggaatcctttcttcctcctagagtttctctgagatggcaagtttgtgaaaattattacacacacacacacacacacacacacacacccatggccaagacaatcaatttgatatgctcctgtgactataaccactttattgcccccccccatttaaatttttaatctagattcccttccccctctctccatgtgctcatggccagcctctagttctctactctctctttctctctctctgcctttccctgcctctgctaccctcttaactcccctccccatgccctgaataaactctattctatactaaaaaataaaattaatctaaatataattacatattctcccccattcccttctccaattcctcctatgttattcctcgccactacacacacacacacacacacacacacacacacacattgcctctcaaatttctggctttttgtatatatgtgatttttctctgggtgcgtatttggtttctacttatctttgttgttgaacaccccaaaagcagggctggagagttggcttggtgtgtaagagtacttaatattctcacaaaggactggggttcaatgcctagcagctgcatgaggcttctcacctcctctgacaccatgctcgagtgtggtacacagacctatatgcaggcaaaacactcacacacataaaaattctaaaaaaaaaaaagtttttataaacttaaaaaaaacaaaagtcaaatataaaagttgattcagggtatctgggagcccaactgtctgcatttccaacttcattctaatgtctgtggcaaaactgttgaaagaagtacctaggaaagtgtgactctagctaatttttaaagatttggcttttcaggcatgcatatcgttgttgctcttctgtttttgagacagggcccccgttattccaggctggcctcgacttattacgtagcagagaatgactgtaaattcccaattctccttccttccccgggcctcactttatcttctacaaacttcttgtgacatactcaggcctttggcaatagactaaaactttctggttttttccctcatcacccctttttgtccatatgggaacaatcttttagttttaggataaaaaccttatactctattctcatctaaaagtatttccttaatttcctttaattttctttatataaatgacctataacttcttacaatattttacatttatttatttttgtgtttgagaaagaccaaggcggggtagaagaagggagagagagagagagagagagagagagagagagagagagagagagagagagagagaatatatggatgtgtccaccacatagtttccaaggatggagctcagggtgtctgccaggctttgaggtaagctccttatcagctgagccatcttgcagtcaagactcagcccgtgtgtgtgtgtgtgtgtgtgtgtgtgtgtgtgtgtgtgtgtgtgttactaaggactgaatccatgattttctaattacatgctaagccattgctctaccactgagccatattgccagccccaagaaaaatgtttttctttctttctttattggtatctcaagatagagtttctctgtgtagccctggctgtcctgaagcttgctctgtagaccagactgggaatcagaaatcctcctgactctgcctactgaatggtgggattaaataaaactattctttaatattctaaatgaaaatcaaagaaaagctgagcaaagtggtgcttgcctaaaattccagaatttgagagagttaggaaggagcatcaggagttcagctcatcttcagcaacacagtaagttccagatcagcctgaattacatgagaccacgtgaaagaggggtggagagcaaagccaaagcaaaccatgaggctgtatatgaaacataggaaacaacatgctatcagtctttgaaacagtcctgtgttttcttacaatttaagttgcactgttgttagaaatttatgtcctgttagaacaggttttcagaaagtgcttttgctaaaggtattgatggcctacttggcttcacaaggtaaccaaccacaggattaaagacttgagtctctgccttcattttgagtctgtctttccgttcatttcaaactcctgcttgactgtgcataggcatattaataacagaaggagtgtcttcctaaattatttcattcatccttagtcatgttgaactccaagagcaaaacctcccaggacagaccttcttccatatgagggcagttatccatgatgcaaggcaaaagtaatcagcttatgcttcaaacatgagccaccctttaaaaaaacaagaactctctcaagacatagtatggtctcaagctcaaagcaattcttctgctgggattataggcatgtgctaccatggccagtcaagatgagggtttctctgggctatcttgcagtaccacaagacacaataattagtcaggctacacctcgaagaaaattacttttttttcataatgagctacaatttatttatttattgaatttggagtattcctcgatatcatccttggcctaagattctttgccatagtccttaaccactacgcaacagcaaccgaccaccttccgtggtttcccctctcgatcgattctacagaggcctacccattcccctagtttcttgttgtcatcaacctttatcaggttgatttggtgctcagcacaaagtgcctccaccagcttgacatacatgggctcatcacagttggatgcgagcacacagagatgggcttggcgcttgtctaactaaggctttggcagcttcgagtatgccacgtgctaggccatcctggatgagggcggtcttgagcacctcttgtagagcagtgttgacgtccattacacctccagcagctatgccttcctcggccatggcggtggattatgggtgacgccgaatcttgaacgcacctgagcttctgcctccgcgcaaattggtggcggcaggggaaaaaagcgaaaattacttattatgggtactccttgttctctattgaaatgtctctcctatttttagtttaaatctcaatactccagcgataggggcagggtcgttgaacccttctatggctcttaccacttgaccacctttgtcatcaggttatgctactctaagttactccatgttatataaaacattattagctcgtgaggtcaaactgccagtggcctattctttaaagaaaactgaacctggatcgtctggaaaagcagcgaatcctcttaactgttgagccatctctccagccccccaaatgtattattatctactctttctgtttgtttgtgtttgttttcaaggcagggtttctctgtggccttggctatactggaactgcctcggtagactatgctggtctcaaactcagagatccatctgcctctaactcccaagtgctgggattaaaggtgtgcacctccactgctcacattccatgggtttatcttaatcacatctcttttattcatattgcaacctcaccagtaccctcagtaacgtcatttaaataaaacaaacaaacaaacctgggactagagacatacctcgatgcttacaaacatttgctactctttcagaaaatccaagtttgattctcagcactatcaggcagttgacaaccacctataacttccgctccaggggctttgctgctctcttctggtctttgagggcacacacagaccatatacataactaaagtcagaaataaaccttaaaaactcaatacttttcaatgatgtaatggggatctaaagagatggctcagaggttaagtatttgccataaaagcatgaggaccagagttcaagtccccaaggcgtgaacccatgtgaagccctcctataattgcagctatgaaaggctcaaacagggatccccagagcaagttgcctaacaagacgtgccatatcagtgagctctcggtttggctaagatcttgcctcagtaaacaaggtagaaaaatgattgaagacattaaacttaggcctatatattcacacacatatacatatgaacctatatacatgtgtatccacatctatggacaaaatgcatatacacacaaaaatggaaaaggcaagggtagagtgggaagatgaacaaatgttttctttgctctctcaaccttggttataaaatacttcctttaaataacagaaacttaaaaaaaaacaaatcaggtatatagctactactgctggacttcagtccatgcccctcccaatacccactcatatctttccttcatcttattcaataagcattcttaagttttctgtaatataaatcaagaatcacaacaatatataactagagagaactctgcggttctgaggattcctcaggttgcataattgtgaccatcaacttgcattgcctgctcctgtgccaagactataacaccggagtatgtaatccggagtatgagctgagaggggaaaaactgatgtggcaagtggaagaacagatatagaatctatgtatttatttacttatttatatataataaaacacttatacttatcacttatatctgtgaccggtagcacatgcttgtaagcacaacactttgtaggcaggaagttcaccataagttcaaggctagtttggtctacatagtgaattccaggtcagcttaaacagtccttggaataaaagaagccacagagatggcttagcagctaagaacacttgctgctacagcagaggcccacattaagttcacactcctctgagacccatccaccatggctctgcttcccaagtgctcgtattaatggaatggatcattacatcttctccaaaacattattatttgtatttacatttgattattacatgccaggagggttttgttttttgttttgtttggtttttttttttttttttttttttttttttttttttttggttataattggtactctataagcttcttgtatgtttataggcttctctttctttattcttttcttttttatgaatgaggcaatttattaacccagtattattttttctaatgcttcttgttggcagctgccacctgttcagcgatcctgtccagatgtgtttcctgtccctgaggtgttagcttgcggcccccatctcggcccttttccaccattttcagccctttcagggcttggaggacctggcaagccatactctcagagcctctgctgaagtggctgggcctaacaccgttcctctgccatccttcatagatcttggtcacggaaccaactcctgcactacagttgtgtacagaggtacaggtccggagttgtggaagcagctcgtgggtagaaccagttctcatcatatggggcaagctctttatgtttggctaacttgactgtgtccacccattcccgaactttcagcttcctggactttttgaggaaggctgccagcgctctgacgaacctgatggttaacatcttttacagtgacttcaggcatcgttcagcctccatgctgccagccaggggaaagggtggcatctctttaggttgggaaaattttcttctgattttgttgatatttttccgggacttggagctggggactcttcactttctattactataacttataagttggtatgcctgttttatgaggtgctggagattgttttttgttatcttatataaagtctgtgaagttgcacatgaaagcctgatctttagatcccttagcactgaaattacaggcagtaaagatttgtctagtgtgagtgtaaatcttgaactttggtcatctggaatattaagcatctcaagagtaatctaagagcagtcttaagcaccataattgatcacttcttaggtctggggactaaagacatgcaccacgtccacctggttgaccacactttaagagatagcattgtaaaggggctttctaatattttctagggttaaagtctattgtcttcatggtagggagcatgtcagcattcaagaagacatagtactggagtttgacatctggttccacaggtagtaggaagaaagccaaccaccggccctggcttgggcttctgaaacctcaaagcccactccctagtgacttatgtccttcctaattcttctaaagtagtgccacctcctccccgctcctgatggcttagtgataaaatgtctgaggctgtaggagtcattgttcttacatgatctttggtagattgatttctgtatagggtgagatagtaccactatgctaaggatcacttggccaagtgactgtatgtctcttacatgtggtgtttgtacctttgttgagtagtggatggctgtctccaggtcctctattctatcccactaatttacaagcctacctatgagcagtagcatgttgacgctgtggtgcaacctgttcattcatttgaagctttgtcatgtagctcaatctggtctccaattctctatgtggctatttctgatcatccttgtaactcccaagggctgggattcacaggcataagctacttaccatgtcacctatttttaaaaactatttatgtgaatgtcattagaattttgctgagtatagcgctaaatccatagatgggtttttgatgcaacttagacaatattatgttgattcatgaacttgggagtgtttcttcaaccattttataccagatcaacccctctcccaatatacgttagaattgaaaaaaatatagatttcctggagagactggatgcctgatctacctatagttgtggctccaactttctctctgttcacagagccagtagtgtcattgaacatcccttcctttaaaaaaacaaaccatttttcatgatttattttgatcatttttccttcctccaactcttccccactcatccaaatccatattcattttcttaaaaacaaaacgaaaactgcgctgttttgtctggatggtgttttcttggagtcatttactgcagtctttctgactccttatcttcatagatgcctgagcattgaaagaaagggcttgatgaagacatctcatctaggaccaagtgttctaaagtctcttactctctgcacattggaagaccatttcttaactcccatttctgtttcttgctgctttgtagtgggtccttgtttcttgacccattatcatcatcatcttgttcttccttcttctcctctttgaatttgcatggagaattcctcaagattactattttaccccaggtgcatttttaatcttaatgttaagaatatgcaatgaggcaggcagtggtggcacacacctttaatcccagcacttgggaggtggaggcaggtggatttctaacttcgaggccagcctggtctacagagtgagttccaggacatctggggctatacagagaaaacctgccttgaaaaacaaaacaaacaaacaaacaaagaatatgcaataaattacctagttaagtgtacaggaatggaggtgttttttagaaaaatatttatttaatgtgagtacactgtcggtcactgttcagatacatcagaagaggttagatatcggatcccactacagatgactgtgagccactacgaagttgttgagaattgaactcaggccctctggaagagcagtcagcactcctaaccactgagctatctctccagcccaggaactgagttttagcacatatcccttcatgctttcttgtgataagactaaaaagtgtccccgaaacctgacataccttgatgtacacggtgtgagaaagaatgatgaggtttgcaagaattgggactaagtaaaacacagagactaaatttaactctttaatttgatgattctctctagcatccccacaaaaatgatacactggcttgcataatctgtgaccagtacctcgcaagttctaaattctctttgtacagctcatttagaagttctcgtttatacaaagccatatccatcgtggagccaggtgctcttagctgtgaagagcccttccttgggtcttttttccctaatatgtcctatgtgacttctcactggtgatgcttttggtgtgcttgttactctgatcctgatcgctctgtcaactaaagttagacaaagtaacctttacttctcaattcagataggaatccttttgcactccaagtttggcttcagatgccttggaaagattcatgctgccacctgctggtttattcagtctgtgtgcatcatttatttacttgttaatttgtttttcttttgttgaaacagtttattttgtagcagatatttttccatccctacctgaaccacctcaatagtaagattagtgaattgctggcactttgatcgtccataagcaaaccaattttgtgtcctttattattcatgggacgcctaaagggaacttagaacagactgtgaattatttgtcagcgtgaatcaacgagacaacaatatcctttgattttctaatacccagggtgtctgatctctttcatgtggatattcatagtttgacagttaacaaaatttgacagttcttttaagttagcagtgtctctggggcgagtaagataccaatgagctattattccctcaggctttgctttggcatttaggaattatttttcattactgctagcgagtaacgtacttcagtgcgtttttgtcccaaggtatggagtcaccaggttcccagagaaagactaagatgccaatgacccaaaactatgagcgtaagcccaccaaatcggtcacaactaatactctgataatttaggaaccaaggagccattttgtgaggcatttctaccctttcctctcctcatctgaggtcgccaactaatgcagaagaacttctagtgtccaagacgcggagcgatacatggtttgtccaagtagaagatatattgaaattttgcatagacaggtgtgtgacctaatgtacattatttaatgtttatgtggaagttctacataaacgtttttagctgtaaaataggataatccttcattatcgcgcaaaataatgaaattcacgcgtcatgtcactgagcttacgtacctccatctttattcattttaatttttttataatatagttagacctaaaggtccaataagatgtcagaattgcaatctttgtggccactcctcttctggtctctccgccttcagcgccgcggatcagttaaaggcgtgcaacggcttgctccagccatgtttgctcgtttcccgtggatgtgcggttcttccgtggtttctctccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaaaaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtgtagcaatggattataggacatttaggtcgtacaggaaaagatggcggctcaagttcttggtgcggtataacgcaaagggctttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacggatttgcttacttgttgaattcattttaattacctttagtgaattgttactttggagtccttaaagttttcaataatttttttggcagatgatactcaaattacttggcacttaaatgtactttctttcaaactcatccaccgagctactcttcaaatttttaagtcttataacacagatactgttaatgtaaagtgaacattatgactggatgtcaggagtatttgaggttctataccagttcaggctttgcttttgttgctattgttgatgctatattgactaatggttttacttgtcagcaagagccttgaattgtaatgctctgtgtcctctatcagacttactgttataatagtaatattaaggcctacatttcaactttctgtgtgttcttgcctttatggcatctagattctcctcaagactcagcaaatagtgctgctgctattgctgccccagccccaggcccagccccagcccctgccccagccccagccccagcccctgccccagccccagcccctgcccctgccccagcccctgccccagccccagccccagcccctacccctgcccctgcccctgccccacccaaccaacccaatccagtccagccctgccccagcccagtcctagccccaggcccagatactttcagacctatcccaagcccacttctacttagagaaattcgaatcttcattgattcagtgctaaaatgcagtgtccatcactcagcctataagactgagacagcccatctataccccctccatactgacttctagagtcatggaatttcacttaatgcatagaatcgtattgctaaaatgcagtgcccatcactcagcctataagactgagatagcccatctataccccctccatactgacttacagagtcatggagtttcacttaatgcatgcagtcctattgctaaaatgcagtgcccataactcagcctataagactgagatagcccatttataccccataccccctccatactgacttctagggtcatggaatttcacttaatacatagaatcgtattgctaaaatgcagtgtccatcactcagtctataagactgagatatccctatgtataccccatactccctccatactgacttccagagtcatagaatttcactttgcatacggtcctattgctaaaatgcagtgtccatcactcagtctataagactgagatatccctatgtataccccatactccctccatactgacttccagagtcatagaatttcactttgcatacggtcctattgctaaaatgcagtgcccatcactcagcctataagactgagatagcccatctataccccctccatactgacttccagagtcatggaatttcacttaatgcatgcagtcctattgctaaaatgcagtgcccatcactcagcctataagactgagatagcccatctataccccataccccctccatactgacttccagagtcatggaatttcacttaatgcatgcagtcctattgctaaaatgcagtgcccatcactcagcctataagactgagatagcccatctatacccactccatactgacttccagagtcatggaatttcacttaatgcatgcagtcctattgctaaaatgcagtgcccatcactcagcctataagactgagatagcccatctatacccactccatactgacttccagagtcatggagtttcacttaatgcatgcagtcctattgctaaaatgcagtgcccataactcagcctataagactgagatagcccatttataccccataccccctccatactgacttctagggtcatggaatttcacttaatgcatagaatcgtattgctaaaatgcagtgtccattactcagcctataagactgagatatccctatgtataccccataccccctccatactgacttccagagacatagaatttcactttgcatacggtcctattgctaaaatgcagtgcccatcactcagcctataagactgagatatccctatctataccctctaccccctccatactgacttccagagtcatggaatttcacataatgtatagatttctattgctaaaatgcagtgcccataactcagcctataagactgagatagcccatctataccccctccatactgagttccagagtcatggaatttcacttaatgcatagaatcgtattgctaaaatgcagtgcccatcactcagcctataagactgagcccatctataccccataccccctccatactgacttccagagtcatggaatttcactttgcatacagtcctactttacttgtccatggacaagtaaacaaagaactcttgtccttcatgttaatcaagatacaccaatcaaacaagagttttatatcagagacttgccatggaggtatcatctctcaagtctcctttcctttaaggaaagaaaaccattctgtcattgctgtagtagtcacagtcccaagtttctaagcagtgttcagtcgtcttttctcatgtattaccttgagtactgaataattctgtcagaaatattttgtccattggattagactttagctagtccagccctgtgtgcatttagcaaaggggcaaacacaggtctgttatcagacagttaaagtgctcagtcccaattttcaaggcattggccattaaagggggtagaatactatatactgttggcatgctgtcatgggtgctatcgccccaggtcacatctttctaactgatggagatacatttatttgctcatgatattgtatactagtctcacatgctttcttatttcagccaaaaacctctgcactggaacattttatgtggataatcctgactaggaattgagtcttttctcaaggtcctaatactacccttgctttatgtaaagagggtgctgattacttaatgcctcttacacaattgtgcaaaattgcagttgttcaagtccccttctgttagtaaccaagatcccataccctcataccctaatgggtgacaatcaagggtgccaaccaatgagaccacttctctgttctggtctttctgctgtgctggggaatcaaaccttgagtcttgtgtacgctagtaaagcactgtcatagagctacagccccaccgtgtggtggtttgagagaacagcctcttatgtagcctgggctgggcgggacttacaggcattgccacctgtaatgtaaacatatttgtgcctgttgtgtgcacagctgcatttgtccctcttcctaagcattggataaagaaaccaaactaagtcaagtcattttgttggtaatcaagaagacctttgatctgtcctgtttttaacttccaggctggcctggaacttagcatataacccaggctagccttgagctcaggatctagcctgcgtttaacaagtgttggcatatctggttcctaccactatgccctgcatgcagtctttcatattgtgaatgtgcatatgtcatttcactgtagtaatctgcatctggtgaagacttatttgtattgcagcagtatttaagatccttaacatagtaaatgtgcacagtgttaactctattgtacatattctcatgtccacagttgtgccttttagatcaggactcctgtacttagcaaagcaaagaggctcactaatataaagcttctttcatgagactatagattgaaacgattccaatacggtcaatggtccttcaaggtaagacttctgtctctgatcattcatatcctctttgctttatggaattatgtatgtgctgtgcacttgaaaccccttcctcaaactatttatgtacatactggcaattttagtaggatcaattttactcttaactttgaagtacagaagtggtgttgacctataaggtcccattttgtggcttgctaataataatgactgattgtagtaggccttttctgttcactacagaaggaaacctgaacagcgtaaaactgtaatggccataaacatgtaccttgcatattagtatgcatttactgcacacatctcattccatttggatacgatcctactctcaaacccttttgcagtacagcaagggtcactaatcttttggcttcttcatcttcctggacactggataaggctgtcccctcctttccactctttaatttccaggactattactttaaagacttaatatttgcataaaggatggggtttttaattgataacatgtcccttgaacattaatgtatataacagggacatgatccattcattttaataaaaatacttggccagttaatgtgtaaaattacacttatccacaaccttattacttttcggaccattgtatctcttgcactcctgcaagggataccgtttatctcccaaggtccctgctagtggaccattaatatacagtgaatcttcctttgtctttgccagtaaacaaaggccatactccttcgcctttcatttgcactatatcaggatatgctgatcaacaaggccgcattcttttggactgttatcatatattaaatgtatgcgtatgcactgccacctgctctgtgcacttgaaaggatcccactcacttccttagcaccttcagcaggaagtgataataagctcaagactttcatttggaaagttcacatgtctaagcacttctctaagaactactgtaccctcttctccgctttaaagcagaaagagggttgtacgaagtgctcttcatttggacttaagtgcattaatgcagttagttgtccatcattacctttggagttggattttacatccttgtactcttttgacaccagaggcatattaattatttctgagcacttctcttgtcaatattaatctgtacccttacacatatgacctgtgcggcagcaaaggttctgaaatgcctaccttttgactggggctgctgagtggtagtaactattagtaacctcagcatttggatgattactatgcaaaaatgtcaaggacctgtgtgctctctttgcataccatcaaggctactgagtcccagaattaattgctaagttatgcgtatttataactatgaatgtctggaatattttgtcccctttacattattgcagaggttgctgagcccccgaaactacccggtactgtcaatgagcacaggggctctgacgaatgacctgctctcttccttaaactgattttgggactcttaataggcacaatggcagttctggatggtttattttctactccaacttgagcaaatcccctgctagtttcccaatgatataataaagtacagcagtatgtacacccaacaatgacccggatttcgaccctttttgcattgctttaatatatacaatcctaaatagtcacaatctcacactttatagtgttccttttgcccggcctctagtttgtccattgaccacttttctgaatcactaattctcacaaacccatcattaaggaagagtttgtgccctttctcaattccatcatgccatcccttttgcctctttgtttgaacagtattgactgggcaaagcccttctcttgacttaaagtcaacaacaccagtttactcacttcatatggctacagtgtctcagttgccttctccttgctcccactgaacagagacacctcgaattcttacattattctgggtaatgttaattaccccaaacaccctatgtgtcattaataaattttggtgtatttatacactgaatagcaaaagcaggccaaaactaggtggatgagccttcaatctttaacttgcacttctaaattattccaattccaactgctggcacattctagggccaggaaccattcttgcctacctttattaatgctttattgtgcaaaatattgcaggcaagtagctcagggagttggattgccaccttttacttggggctttcctttacagtatgaactgaaaattgtcttcctgagaaggaagcttagcacttttctttccattcttcctccaggaaggagccaactgtctgcttaagaaactttaagcccgattttgtatattgctactgtacaggaccaactgccagaaaagttattgataattttattccttaagaaaggcatttggattgcaaggtggattgactgtgagatcattagcttttgtgaagtaaaaatagccatttgtgtcatgtttctgaagactaagcagtgtctcagtgtactgagggtgatgagtctgtggaaagatcagtgcaactattgcagaatgtttaagacaagtatctttgcttggtctttactacaagtttaacaaaacgaaaaagtcaatctttgtgtggcctttagtatgattaactttttggaagatgacctaagccttctaatcattatattttgtctgacattggtcaccagtccttgcttatttttaaaaggtgactggatggattaaatttgagaacatgtcaagtcgcctttgaaaattatataggccatcacatttaattaattcattctatccaccattaaactctggcaataatttgaagtagcttgaaaattcctaaagtgggaatttattttagagatgatagaacctgtttccccactttacattttaaaatatgtctgccaggatctaatcattcctttaaacgtacacttcaaagagagattttcctagtaagaaaagagctttctctagtgtgaagggtgctttgtagccgccgagtacttaggtcttttttgggagctattgtgtatgagtgtatgtatgtgtgtgtgtacatgcatgttgctgcgcgcagtcattcattcacatggtgctcagacaacaatgggagctggttcgtctatcttgtgggtcctggagatcaaagtgagatcatcaggcttggcagcaagtgcctttaccctccgcgtgccatcttgccatcccgctgctgagtgtttgatatgacattgctgatgaaaataatcatcacaacagcagttctcccagcattactgagaaatgatactatttttctgaggaggatgttcaagtaactcatccagtgcaggatcctgcttgaactactgctcctccgttacatcagactctggctgtttagactacagtaagtactaccttgttagctactaagctatctttttctcattcgagtttctttctgtgccacccactgaaaagtcaaagtgactaataagtcactagctcttctcagcttatccatacacaacacatagtatgccaacgaaattgtagaattaacacattgtgtacccaatcgccattatgctggggtacactaaaatgagaagcgatgatattttacaaaatttcttccgtgagatgattatgttatttaagacttaatgtaatataagcacacttgagatcattttaggaaatgtactgcctgtgtgaattgtttaagtattttaggaagtctactggggttgaaatttgacttcttaaagagggaagtgtgcttactttgccttgttggtccagacgactattagtaccatctggttggtttatctgaatgccatctgtttctatctacctcttggaagcatggaaagaatattaagagtgaaagactccatgcattatgcttagctgtacgccaagggtagcaagagatgagcttgtgtaggaattgggaatataaatttgataatttggttctttcaaccatttttactgcatttctgcccagaacagaccactggacggcactaacagcttagacagagaacttcatagcttacaatctttttttttttttttttttttttttttttttttacaaaagtgcaaagaaggataagttttatgaacaaattttactatggactactttatgtaccctccttgctcatttttctttttcattaattaatcaattaattttgttttgttctctgttttgttttgtgacagggattctctgtgtagtctggctatcctggaactcaaactcaagagatccgcccgcagagatccgcccgcctctgcctccagtttagagtgttgggattaagggtgggtgccacactggacccctgccagcacttttcaacagatactttcagttaaaacaacaaatacttgactcctgtgtagaaaatggtctagctgaaaaaacatccttgtccataacacttaacatttttttgcatttgccttttgtacgtgcaaatgaccctctagtactttaacccttttaagtccactgtaaattccttcgcagcaggtttcccccaactccaaaggcttagcattgtctggctctctaggtgataatacatctagaactattgagtcttttaggaaactaggaccattgttgtacaagtaactgcttcaaaaggaaacatttgcaaggaaaaaaagctttttgagatgctaaagaatgtgtttggtgcactaagacagttagctaaagcttcggtctcaccttagcaccattggctacccaccccagtacatgcaaagtgaccccccccccaggcttgcctaggcacctagagctttcagcctgcctcctatggacctaaatagagattaggactcagactccagttagtggcctggaggaagctggtactgctgctattcacagtaaacccactatcactgacagttccctattgaaatgatcaagttgtgtgagcaggcagatcattaatcagggccaattctgtcatggcaacctagtcctacatgacctccacggcactgtaaaatacacacttatttgtagtaggacatctggaacatgagcttgtctgtgattgaaatgtccattaggaggtgccatcacacaaaaccatctggaggccatctttggtccccataattgatggaatacaaagagttccccaaattagtgtcctgacccagccctcactgtcagtaatcatgtaatggaaagccaccaactcgccatcaccatcttcaggctgcctgaactgtatacattaagaatgagctttcagccgggcagtggtagctcgagcctttaatcccagcacttgggaggcagaggcaggcggatctctgagttcgaggccagcctggtctacagagtgagttccaggacagccagggctacacagagaaaccctgtcttgaaaaaaaaagaagaatgagctttcttccaagctgtccaatggcttgacccagacttaggagtttgtaaacaaagaaccctgtagaacaagtgaatttgagaatgtacaccttcattaagtggtgggaagtggaagtagtggattttgccagctgattttacaaagccctgtggcagaaccagaccaggtctttgtatgcatactgccatataacctagccactgtccaacctgtgccctctctcccagtccagtgaacctcttctgcctgccccttacttagtcctctggctcatcccaggggaagatggctctatttgtgtagtcataagaaagttttgttaattttaaataaaacaggaaaagagaaagctcacttaagacgagagctggagagatggttctgttagtcttccagaggtcctgagtacaattcccagcaaccacatggtggctcacaaccatctgtaatgacgtctgactccctcttctggcacacaggcatacatgcagatagagtactcaaatatacaaaaagggaaaagaaatgaaaggcctttgaaatgtagacatgctttcaattttaaaggctgttttcacatctcttaagaactaggggttccatgagaacatatcctcaccctgagttcttaccaccaattgaaaacgctgacatgtgcatatgaagattgtattgctagtaatcaaattatcatttgtagagtttagtataattatcatttgttttccagggatgaatttggagtctgttttgtgctcctgcctcaagaagaaggattgcctggatttagaggagtgaagagtgctggagagagcccaaaggtatttccgttacttggttgactgagatagtatcttcccttaaaggtctaatgtgtcaagttatacctcctaagtaaatacctcattattttcatgtggaattttcaacaatttttgtagtctaatgatagccttgtatttcttcacagggacaaacaatccctatgtgagactcaaggactgccagcagcctatacagctacattacatctcagcagaacttctcttcaagtcctcgctactctgaacaaaaagcttacaggccacatggagaaaaaaaggtactttggagaatttgctatttgggggtttctatctgatctccagttcatcagagaatgagggggcaagtcaataaagcactccccatctcctggtcccctggcatagtcagttagccaatgagatccttgccttatgatgaggccttgaaatcatccccaccatgttatgaccaatctgtaacatttctgctctgaaatgcctaaaaggtaggttatcagaggaatgaaggccagtttctgacaccctagtcttttgtacttgatagagtaagtagatatggctgttgtcacattctgtaggcctgtcataattctggtctctgaatatcctcaaactcagaggtccaatgctacaccagtttctagggacatatgcaccataagcactgagccaaacaatgctattcaccttgccagtgttctggcatggtattgtttaaagcacaaattaaaagaagaaaataatttaacccctttattcccagagtatttgaagtacaaggactttaacacaacctataatctaaaggatctctcattggtaggtgacagaataaaagccagaaagaacttggatggagcaattctcatgtctctaagttaacactaagatctacaaatgtgaagggttcactctccaagcccctccccatgatttaacacaactgctggttactacataatgagacaactttcccagtattcttgatttcaagaattggcttttctttcacctcttttccagatctccccccagaattgtgggcttgctgctttgcagtgctggcgacctattccctttgacgatccctaggtggagatggggcatgaggatcctccaggggaatagctcaccaccactgggcaacaggcctagcccagatttcagtgagacgctttcctgaacccagcaaggaagacaaaggctcaaagaatgccaccctacatcaaagtaggtaagttttctgcaacagtgtaataattttaactttgatcttgttttccattaaagtcagccttttacttgagatatatacataaattttatctttttcccacatctgggaaatgtaactaaacagtgcaaatgtttcttctaggagaaaagctgctgcaatagtggcactgaccttcgaggaagccattctgctctatttggttctctctccagaagctaggaaagctttgccagctgtttacatacttcaagatgcactgctaccctactcatgccatataatacacaagtgagtagcttatttacctacctagctatttacgagtacactgttgctgtcctcagacacaccagaagagagcaccagatctcattacagatggttgtgcgccaccatgtggttgctggggattgaactcaggacctctggaagagcaataggtgctcttaaccactgagccatcactaacattactgatgatgaatgcctctaactacaaatggaaacctggctggaattgatacagaagtatctatcattaggcagaatttaaagagccaggatgttctagtacttctttcctggcattcatacagcttcttttgttctttgtagtgccatctaccaaatattacccttccccaaagcagcacagaaaactgggtcttcagcgtgatcaagcaatgtgaacacacaaaaggaaggcagctttataaatgacccgaggatcaacatgcctgactgcagcatcttaaaagcaatagaatgaggtaagtcactagcattgcagtcttctgaggatttgcatttgctggaagatggtgctgggtggagagcatctaatgtgataatgtgaggcagggccatgtacacgatggaagatgaacaggctttcacgttatcaaatggcctcacagcagcaactcaaactattatctgcttaccagttatatcacaagaggaatttagcttctaggttttgttgttgttgttgtttgttttggcttggtgccctaccattcttacagacttaaacattgaaaagctttaaatagtttatttcttatctccatctgtgaagcagccattagacttgtgaaggatgtaaaaaccaagcccccccttttttttaatagaagaggagagtgaagctgacaattaaatatgcagtcgcttatagtgtttgctgcttacagaagcttttaatccatgtaacagaatgttgagatgttcattctgtgtttaaatgtaatattccctagatgtatgccctttggcaatttagttctgctaagacctgtctgtttgtgaaggtcaaatgaaatcatgaatggaaagtgttgagtacagagcctggcaaatatgccctggagttgcatgactaggccatttggaagagttgacgggtgtgtcctatggtcctatgttaaggaaaccttaagtttaacgttgatagcctggtacagtgtactaatggcaatttttttctttgcccttccctgtttcttgttaccctctttctggtggtctttgcttactatcaatcattagtgtgtattgtgggtgtgtctatttcttgttttatgtatctattttttccttggtctgtgtgtctaattctttgttacatctatttcttccttgctttgtgtgtctatttcttccttgctttgtgtgtctatttcttccttgcattatgtctaattctttgttatatctatttcttccttgctttgtgtctatttcttccttgcagttgtgtctaattctttgttacatctatttcttccttgctttgtgtgtctatttcttccttgcattgtgtctaattctttgttatatctatttcttccttgctttgtgtgtctgtcttccttgctttgtgtctatttcttccttgcagttgtgtctaattctttgttacatctatttcttccttgcttttgtgtgtctttctttcttgcttttgtgtgtctatttcttccttgcagttgtgtctaattctttgttacatctatttcttccttgcttttgtgtgtctatttcttccttgcattgtgtctaattctttggtatatatatttcttcattgctttgtgtgtctatgtctccttgtgttgtctaattcgttgttgcatctatttcttccttgctttgtgtgtctatttcttccttgctttgtgtgtctatgtcttccttgctttgtgtgtctatgtcttccttgttttgtgtatctacttcttccttgtgtgtctaattctttgttacatctatttcttccttcctttgcatgtctccttctttcctttgtgtgtcttttctgtctgcagtgtgtcttacctattcccatgtttctcctgcatgttctttcttgcagagctttgagctttgtttcactttctctggtgcctgtgtggtctgctttgtcttcactagctatggctctctgttttatctatctggttgctatttctcttagcttttctttcactcctgcctttcgtgactcccctttgggtcacatgttgcatgcatccctctctttttcttgtgctcaccccacttgttctttgttcaagttctctttgtcagtccatttcagttttctttctgctgcttctatccttagtgaattcttgtttacatttcttccctgcctttcttgggccactttctctgttttcttttgtatttgtgtctctttgctattggtggatttcttatctcagcatcattctgttgctttgtgtttgcttgtgtttctatcttctactttcctcctttctgttcactttgagcatttcatctctttacaagtctgtgtctctcttgtattctaaagtaatcctttcttggatgtttctttgtatgtacatgtgcgtgtgtgcatgtgtgttatgtgtgtcatgtgtgagaggagcttcatagccccttcccaataggtccagaatgtcacccgtggagccgttcctcacaccagactgccctgagaaataatctaagacaaaatacatcattccgtccggtcaggattcaagtggctctgaagtgaacgcccaagtagaagacagaagttttgcgacttgagatttaaaaggaccaaaatacacagatggcccgtcttgagctggctggacagaatgctgacaacccaaagaagaggaactgtttctacaggacacctgtgacttccaagagcggggaactacgtatgtcataagacacaaaacctgagctaagtccaagcataagacctaaggacccaatcctatatggacagaatatttaagagataaaggcctatggcccagaactctggaaggatatttctatccttctatccccaagaccaagaagggaaattcgaagatgagacctgccccccaaccccagcatccctttccatttcttatatttctatttaagctgtcttcacttgagatgtaatttttcattgttgccattgcccataaaggaatacgtttttagctggatagtattgtgcaagggtctgttttaaactgggtcttagccatttgttaaattgttgatgttttacaacttccatttctcttcacatctgctccacttgagacggaactaaatccagccagtgtatatagcctgactattgaaacttccctaggaataagcatgcatacagatatgcatactgccatcctccctacctcagaagccctaggctgacaagaaaaggaaagcatcaggttgttagggggaaaacaatgtcaggctatctagagaaaatataaagagttgttccagaccaatgagaagaattagacaagcaatatgcagatgtgccaaccctctgagaagcaccagccagtgtcaccttctttctttgggcttaggtgagcagggtatggttttctaataatggtttggggacaaaatgaggtctgaactccctgctcatagtagtggccgagtaatttggtgcatttcaccaaaggaactcctgggtctaatacctacctttaaaattaatgatgagagactctaaggactacttaacgggcttaatctttttcgtgccttcctcttcctctgtaagagggaagttaaatgacacaggatgaaaaagtaacatgctcatagcacattggcaattatacatggttattatctgaaagtgtagagcttttcctataaggcatcagactaagtacctgaagctttgtgggttcatggtcttagttgcatattccttagttgcaaatccttttcaaaaggtaagaaaaaggcacactggtctattgcctgtacttgatcaagccctgatatgaatgccagggaatgtctgagtaacattaatttccttccctgcatattttttgtgctgaatactaaggctgtgatgcttcactgtggtcacccccaggtaacaagatattaccaggtaaccaggaaacgtatgaatacgtaaaccatgaagcctactgtaacttccaagtcagtgctgagtatgtattacatagtagctgaagtctacgcctctgtgtgctataggcacaaagattgctctaggaataacatgctttgtaaaaacaaatatatgaacataacggggcttgaatgaataacagtccatatacttaaggccagtgtgtttcttctgctttggtgaggctcagtaagttatattataccaggtagcagaagagaaaacacatggaaactgattttaaactacaaactaggtcactaatgcaggtgattgattaccctattctgatcaccttctaatttctgaatacccatgttcagcactgggaataacaaagggggacattaccacagaactagaatttacaaaagaatgcattaaataaagcattatacagctatcaattgttccatgtgtgcaaatgaatgactactaactacctctgatgtatccgatattgttttgggtacatgaaatattcatgagtaactgccatgaaataagaatgtttgcattccatactattcataaggaatgagccaatgcttaatttaatcagtcaaaacttgagtgataagggcatgttaatacaagaacatttgcccaggtcacattatggttgtgggtactttcttaactataaagcagttcagtagtataagacaagacaaattttctatagaaataaagctgcctataaaataggcatagtctctacaaaattttcattgtactttttagcccataatgggaagagtacagttaacaagctgggtgtggtagcatgtgctctgagctgaagcaacaggaccacttgagcccagaaattggaggctagcctgggaagaccataaggtcaatctcaaacctggaggctaaatattgtctcccatgtgtatattctctttcatgggtactggagagatacacagacgtacatttcagtgtgtccacacttgagaataatatgtacgttggcattttatgaactcggaggtaccatataaatgtaacaattcattttcttacttggtatcaatttccaggcttttaaaattctgccacatttattatactgtgaaaataaagtaaataagtaactgtgaaccactgaatatatgaagcattcaatacttgatgagtacatactgaatggcagtcatttattacaaaacagtgcccttgctaggcactgggatgcaaagagcattctcattgtcctgtgtatctaaagaaattatgcatgagattaatttataatttgtaaactgccatatatatgtgtatatatgcaatatttgcctggtgtgcaatgactttgcttttatcccaggcatgcacaacagatctgtgtggagctttgtgaagtctacagttctataaagccgggacctaactgttggctttatcagtgaacagtgattactttctaagtttcataatggctgaaacttaatcataatgcttatcacctaacaccacctaataataattttaccatgctatgtgttgagcgaacacatagattgctttctagcattatgtagcacttataggagtgaaatctagaccaaaacttcaattcacttcaatgaggaaatgaaaacagaaaaaaaaaatggatttgtgcaaggcagtgtgctaaatgttacactgagtggactatgctgtctaggatacttcccagctggcttgactgaggaggtggaaaaggttttattaatgacaggaactttttccatccagtttcttaaatgtttgttgaatgctgctgccagagatgaattacaaacaccttgccagtaaaggagttttatagggccagagtgagataatcccagagcatgggtatcagggaacaaaacgggaagaggccagagcatctgatggcatgtactcagtgtggcccagaacctctcgaactagatgtactggctggagggaccaagcatgcagaacacaacacctaatgaaacattgtatataaaatatgctaacctaggtcctaaaactaaaatgtgaggtggacctagtgtagatcactgatcataggagacatggtctcataaagcccaggctggttctaattggtgactgtcacagcttctcaagtgctgagattacagatgtgcttaacccatgcccagcctgaagaatatatctgattactgagtgaataatatttttaaagaattatatattttatgtatatgagtacgctgttgctgtcttcagacacaccagaagagggcaccacatcacattacagatggttgtgagcccccatgtggttgttgggatttgaactcaggaccttcggaagagcagtcagactcttaaccactgagtcatctctccagccttctgagtaaatattttaactataatggctgtttgcgaaacccaaccaaggccaagattccttcaacataaactggagacttcctagctaaggaagctccaaaagtcattttctcattggcctagcttgaagccaggacagacttaaagtctgtcctttaattcattacccattttccttttcttactgttgaagtgtttcaaaggagaatcaagatgaatcgataattctaaacgtatttgttcattgcctggctcagcgtcatgtgagcaagaagaatatactatcacactcatacttttaacttaagtgtgatgaaagtgcagttctaagtactaaaatttctaagtactgaaaagaacaaagacatttaaaggatgcaacccaaagtgtactttacctcagtagtttctgaggggactgcagtcacaccttgagactacagctctcactttagctgggaaaaacatcaaggtgtagaggaggcaagttaaataaaaagttgctcccctcctcatgggcatgcttggtagagtggaaataataaaagaggttctctatttcctcggttccacacattgcagaagatgctactggatgctaagtgcaacacatttgttccaaaagggcactcagtgtgacttacagatgccccggaaagcagagggatgctctttattaaacagaaatattagctcaaacgttttctagactgaagaacactttcctcatttcccacagtttgcctcagaggttgaatacaggaaggttattattcattcatttgctttattggttcgcctgttctacaaggatttgcatgtctcttaggccttcacttggctcctgagacatggaaaaaggaaacatagacatagggaagtgctggatggggggggggggtctcttttctgggtagtggcacgacttagtccttagtccccaagtaatatgcaatgtgagtcctcatcctcatgtcttctccggccactgcaatgagtgggaagctgggctttgtagcaagcctgaccctaaagttacagaagccctccacgctaagaaactcaattttctaggccattttagctatgactgtgaccactactggtcaggagggatgacagccatctaagttccacaatcttaggctactttgcattatcctggggcaaacaagccatttttgagctgcagcaggctttgaaatacattgaccaattttgcctgtgttcgttaaaccttttacctttttacatgctaatgctcacagtaatttagaaatgttctccttactataatatactcaaggtggcttgctatggtaaaataatgccagtggatgaaaataacattaatgtttaacattcttgcataaaatttaagaataataaaattgacaacaatcagaaaactggaggaacgaaagaccaaattgaaagaacttgaaaaagattaaaaatgcctgtgctttgaccctttccatttttctttcactcacagagggtgggacaggaggccgagtgaaggaaagggtccagcctgtctatctggaatctaagttgggactttaatgcagttccacaaaattggtattaattcgctaaatgtttctgaaaatgtattttcatctaaatggctatcagctaagccttgagtcaaatgggaatgaaacagattaagtcaatgtgatctctttatccaagttgccttagagctgaagtcacaatttgctgtaaggaagcttattcattgtagcatacgcatactttcaaagtatctagactttacttagtaacccaatcaggacattcaggcaaaagaaaaggaacagagaagatggagccaggttgaagaggtctgggagttcaaacaaatttttttcattttcattaaaactcaattgggcatcaaaagtgttactaatattagcttttaattagtggaaattggctggattcagtaatatccctttgtatgggtaggaatgggcttacatttctggaatttgcaaaggaaaaaataactgaaagccttcctttcacagttactgccatcaatattgctaccaattaagcacatcctaccatcatctgctttgatcacataaatgaactgtgtaccaatctgttgttgaaagactggagtcatcttcccaccaactgtgaaaaaacacatggaaaacacctggactttgtgaacggatgcggaatacagaacttctgttgactcttgggtgttttgaagacttgaaaaaaaaaactgttgcttaccaacatgtcacaatgagtccgtgtgtgggtgggtggatgggtgggtgggtgggtgggtgggtggttgagtgggtggggtagtttgctgttaaataaaatgctttgttttgaaaacatcatgtgctgtatatgatattttccttaaattttatttaatgtgcatgagttttgtctatgcattaggtttgggtgttatacccgtgtaggccagcagagggtgtcggatcccaaggaaaccaagttacagacgccatcttgtgtgtagccggaatgtaattcagatcccctggaagagcagttagtgctcttaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtatcttaaccactgccacattccccttttcctttgcatggagccagaactaggctagcctccaagtccctaagtagccggaatgactctgagctcctgatcctcctgtgttagaattacaggcttgtaccactaagcctgcttttcagatgatagtttctaactcagtggcccttttatcataccagatacctcagttttaattccctatgtaatgaaattggttatgttgccctggccatctggctagcctgaagtccatgtagattaggctggccctaaatccatagagcactgtctgctactgactcaggagtgctcggattaaaggcctacaccaccaggcaggcctagccagttccttgggtaatttgaggtctcataacttagagcctaagttgttcaggagaaagattatgagaacacaaatctaataagatcacgagaagcaaaatattgaggctcaaaagtgggagtactggtaagatgaaatgaaaagaaagaacatggctgtcaagaagtccttgaatagagaaaggggcctctgatagttctaaaattcaaagtgacaaaattgcgtctaggagaaaagataaattctctcaggagagagtttgtactgttagacatggctctgcctagccattgctaaccagtagaagtgctccaacaaaaccgggccttcgtttccatccaatgaatgggccagaaaagcaacaacattttacctgaaatcagttcaccttatgctaatacaaggagccaacaaaaccacaaaagcctcatctacaatgtgattggcaagaagagaaagatagacaggtactgcaagcgagtgtgagtgaggcaggtacaagaatctattatggtaaatcttaacatctttggaaaatagcattggcccaactccaagaagcccatgaaaccttaccatttattactggcaactaaaggattgggacacagggcactcaaacgtatccactgatgagtatttaatagttccaaactatgtctggggtgaactatgaaacactaaacaaaataaaactagcaaatatgacagagacattttgtaaggaataaggggtgctggccagggcgggagggaaattgaaagtggaagagtaagcagaatgcattctatatacctatgaaaaatttctaataaaaaaccctatttaaagccgggcgtggtggcgcacgcctttaatcccagcactccagaggcagaggcaggcggatttctgagttcgaggccagcctggtctacagagtgagttccaggacagccagggctacacagagaaaccctgtctcgaaaaaacaaaaacaaaacaaaagacctgtctgagctggagagatgatggctcaggttaagagcactggatgctcttccagaggtcctgagttcaaatcccagcaaccatatggtggctcacaaccacctgtaatgggatctgatgccctcttctggtgcgtctgaagtcagcaacagtgtacttatgtaaaacaaaatgttttaaaaaatagaaaggaagaaagagagagagagagagagagagatgctctcataaacaacgtggaaggccagatgcacacctgaagttgtcctctgactccattatgctctgtgcaaccctcacccacaaacgtgtacacacaccatccacattcatatacaatacgcatcacacaaaagaaggaaggaaggaacgaacgaaaaagagtcaagaggagggctgccagcatccttgccctgatggctagggtcgctgcacgggtcagcagcactggactccctcgtctgactgtcaccctggtcatttagaagccaaacactgcgattcttcaaaggcgggatctgggctaagtaaggatgtggctcagtggtagagggacagccagggcctcgaactcagaaatccgtctgcctctgcctccggagtgctggggattaaaggcgtgcgccaccacgcccggctttaaataggattttttattataaatttttcataggtattgaagaggcacacatgagccccttcatggtttgctagaataaatgctcttggtgatataacttggtttcctcagcctgggttcctcaactagaaacaggcagttaaggtccaaggcatgagttgtgagctgcccgggtcttccaggcaacctgcaagtgacaggttcttgctatgcatgggcatccttattccccctgggtgaggagctttggaaactcaggggcagggagactccttctgaggcttctggaaagagagaatagatgtgaggatcaggtagaagttcccagactgtccctgccatccaagagggaggcaggagctgggctgggtatgggtcacaaagccagcagctgctagcactgagggtccttgcctttctgtcccatggcccctctcccatctgcactgtggttgcagagcctgagccagcacttcccccgactggagaatgacagaggcagagtccactcctcccattccggggcgggaagccaccatgttgcacctgggcccagcagggcctgggaacacgaggagcccacggcacccaaagccctcccctcaacccaggtccttgcgcaaggtcaggagagggcaggcaagtggccattaaaactgccctcccggcacaatggcacagtgaggtgaagctggcacaagaataaagaagaggaagaaatagagctgtagatagaagagacagcaacgtgtaataacatggcgccttcaagggtcaggaagggctattctgcaagtaatctcaggttaattagttcctctgtgctttactcgaaccaaaatttgtctcctatcagggagagaaggtggagtggataagattaaactaagcacacacagagacaattgtttttgcttttgtttttctttcatttttgagtcagggtctcacattgcagtcctggctggcttggaagtctctggcatactgctggaaacccaagcactcaccctaaccaagcactcaccctaaccaagcatgcaccctaaccaagcactcaccctaaccaagcactcaccctaaccaagcactcaccctaaccaagcacacaccctaaccaagcacacaccctaaccaagcactcaccctaaccaagcacacactgtaaccaagcactcaccctaaccaagcactcaccctaaccaagcacacaccctaaccaagcactcaccctaaccaagcacaaactgtaaccaagcactcaccctaaccaagcactcaccctaaccaagcacacaccctaaccaagcacacaccgtaaccaagcactcaccctaaccaaacattcaccctaaccaagcactcaccctaaccaagcacaaaccctaaccaagcacacaccctaaccaagtacacaccctaaccaagtactcaccctaaccaagcacacaccctaaccaagcactcaccctaaccaagcactcaccctaaccaagcactcaccctaaccaagcacacaccctaaccaagcactcaccctaaccaagcacacaccctaaccaagtactcaccctaaccaagcacacaccctaaccaagcgctcaccctagccaagtactcaccctaaccaagtactcaccctaaccaagcactcaccctaaccaagcacacaccctaaccaagtactcaccctaaccaagcactcaccctaaccaagcatgcaccctaaccaagcactcaccctaaccaagcactcaccctaaccaagcactcaccctaaccaagcactcaccctaactaagcatgcaccctaaccaagcactcaccctaaccaagcatgcaccctaaccaagcacacactgtaaccaagcacacaccctaaccaagcactcaccctaaccaagcactcaccctaaccaagcactcaccctaaccgagcatgcaccctaaccaagcactcactctaaccaaacactcaccctaaccaagcatgcaccctaaccaagcactcactctaaccaaacactcaccctaaccaagcactcaccctaagctcagttccaatagaaagaataactaaaagaattctgtagacaagggagggctttctaggtttaaaattaatttactggtccctaaaaaacaaacaaacaaaggggctggagaaatggctcattggttaagaatgctggctgctcttccggaccggaccgtggttgtggttcaattcccagcacccacatggcagctcacaactgtctgtaagtccagttccagggtatctgacaccctcatacagacttacattcaggcaaaacaccaatgcactaaataaatacatacatacacaccgaacaacaaaagactacaggtctgaaaaaagccagtaggcattgcaagcctggaggtggtggaccatggatcagaattcaaggctgggctgggctacatgagagcctttaaaagtaagtaaataaacaaggccttattctctattcccactagggaaatgaagcaaactataattggatatccctcgcatctacctacttggaatagctatctagaacctaggaaccagctggtgttggaggcaagggcctgtaaccgcggcacttgggagatttagagcaagaagatgaagaattgggtctatcctgggcaatgtcatgagactctgtctcaaaaaaaaaaagaaagaaagaggagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagctggaaagatggctcagtggttaccaagaacatttgctactcttctggagcccctgaatttgttttttgtttttttaaaggtttatttattttatttatattagtacactgttgctgtcttcagatataccagaagagggcaccagatcccattacagacggttgtaagccaccatgtggttgctgggaattgaactcaggacctttagaagtacagtcagtgctcttaactactgagccgtctctccagctcctgaatttgttttttgtttgtttgcttgtttgtacgttttgagacagggtcttgtagcccaggctggtctcaaattctctttgtagataggatgaccttgaatttctgacacttctgccttgacctcagtgctgtgactacaagcacacccctcacctggtttatgcaggttccggatggaacacagggcttcaggaatggcagagaagcaagttacctgactcttgctcagccattttgaggctataggaggagggggacaccaggcagtgagtccccatgtcaaaaaataagtcgagccaggcagagagggacgtgcttttaatcccagcacttggcaagcagaggcaggtcgatcactgtgagtttgagaccagcctgggctatactatatagtgagccagccagggctaccctggaaaactctatctcaagaacaaatcaatactgtactctcctcgaccttggccagagaagtttcttctgcaaggaggagcagctaatgcagactcagagctggcctgagactgagcaacaattgcatgcttagctccaaacaaggtgtctatagcaacccacacactgcccaaggcccatggaacatcgtggaagcagggctggaaagaacatgagagctaaagatggggaggcaagctgtgaaaatgctggctgccgccctcacaagcgtactgcggctgtggctacctgcatacgattccgacaagattagccaacattccagcaagcactgctaactggactcacagggttgttattattattatattattattattattttaaaaggagacctcattaaggttataggaagacagcttcgggatgtgtagggagtgggggagaagtacgagtgaatgcatgtatgaaattgccaaggaataaataaatattaaatatagggaaaacccaacacttggaaggtggaggcaggaagggcaaggtcagcgttggctacggagcaaactcaaagccagctgtactgcatgagactgcgtctcaaaagaacaaaggtggaagaagagctcagcagttagcagcacatgttgctcttgctgagaggacctgagtttgctagcaagcacctaagtcaggtagctcacaagcctctgtcactccatctccagggggccaatgcctcagacacacatatttaaaaacaattgtgagcagggtgtggtgccgcatgcgcatgcctttaatcccagcactcaggaggcagaggcaggcggatttctgagttcaagtccagcctgatctacagagtgagttccaggacagccaggactacacagagaaaccctgtcttgaaaaaccaaaaaaacaaaacaaaacaaaaaaacaattgtgtgtgtgtgtgtgtgtgtgtgtgtgtgtgtgtgtatgtgtgtgtgtgtgaaacaaaacgaaacaaaacaaaacaaaacaaccctactttcatatttttaccactggtagtaaaatccaacactaaaaggaattcctggcataagaaatcttgaggatgaaaagtcaatttaagggtatgtttgaacatagcactctgataaagacaccatccacccatttgtctaaagtgagttagtcttcccaatcaaatcctcacttatgccaatgcctgccttaaatgttttctatgtgtagtctcctcaattaccatcaacattcaaaccatcactttcccctataattccatttaccttggactttcacttccagccttattctaatttcttgggctttcatgtttattcgtcaactttcattttcattatacaaggacctgataagtttttattgataaaagttttattatttgctatgaattgaatgcggctatgccctcatgtgtgtgtgtgtttaaatagtaagctcagatgtttacttaaaaacaaaacaaaacaaaacaaaacaaaaacatgtgttttctagccaagttggtcaggaactgactgtgtagcccaagctagtcttgaactagctgcaatccctttctgcctctgcctttaaagtgctaacaagtgtgagccacctgcccagctataactactattttttaatgtgagcactttctgttctcacagaggacctggtttgatttccaacacccacattgtggctcataaccatctataactccagttccagggatcctagcaaaccctcttctgacattggtgcccaacaggcatacacatgattcacaaacatgcaaacaagcagaacactcatacacgtaaaatctaaaataataataaagtagacctatagagtatatataattccaaatggatttcagtagaagaccctacttacattgcacagaaaaagctgtctggctgcttcaggcatgccaatatcagcacatgtaaacaagcttccaactttgtttttgagtaatcaactcattattcaccagatctgaggctatttctattcaacagcacaagaaaagaagggagaagcaggaggatctctgtgagtttgaggccagcctggtctacagagctagttccaagacaccagggctgttacatagagaaatgctgtctcaaaaatgaacacacacacacacacacacacacacacacacacacacacaagcgcaagaaagaaaccattcgaatttgactgcatatgtacataaaacctttaaataaaagacgtaatttcaaatcaaatgaggtcttaagaatggagcctaaacctgtctgtctctttaccagacgcagggcagccagaaggcagccattcacaatccaggaagacaggaagggataacaccagaacccaacctccattttagagaggtctagcctcttgagctatgacacactatttgttctctaactacccaaagttgtattttactatgctaattagctgattaagacattaggtaaaggtgttctacaaagaaactgtaaataaaagacatactctgtgccttagcctatctcatgattccttttctggatgtcttcataaccaccttaacctctacgaagatacagagacacaggtagcactacagtgctgtatttgtttaagcccccaacaaacttggtggcttaaagcaacacagatctataaccttataattttagaagtcagaagttcagtgtgagacacctagttgaaattgaaattattatttgaaattaaattgaaattattccttctgtaagttttagagaattcatttccctgccctttttagcttcaaatttcttagctagtaattgccttcctctatgtctatagccggatgtagagtctttgtcaatcttttatccctgccatttcaatgaaacaacaccttaccttctaggggaatctttttatctcaaggtcgattgattagaaacctcagtttcttcctccaatgtaatatagtatattagtatattctggggagtcagtgtttgtctgcctactaacacaggtaagaatttgcataggtattacaaaatcagtactttgcaaatctttcttctcttccgaattgaaaactgaacattaatccaaacatggcggcagaagcctttaaaatcggcactgtcccactgaaggcagtggcaggcagagctttgcgagtttgaggttatttactgagaccttgtctcagaaataaggcattaaaaaaaaaacaaaaaacaaaattcaccccaaatccgcatcaaaaccaaagctgattgttaatttccctcctttctaaactggattcattccttagtgccattgtttgctcgtctgaacacactgaataaacactaccgggagggattttccgtgcctatagtaaataagaatatgatttttcagatacgaaccactgagaattgttttgccttgcccgccacccccaccccgaaaatactccttgtcccagatagtagaaacttaatgggttttcaaagcactcagattattttcgaatttcaacgataccagagatcgggtcattatgtacctcggaaataaacggaacgcagtaccaaaattttaggtctcaacttccaaggcttctcaaagaaagttatcgcagacttagttactcgttcttggttacttcacacgctaccagtaatttttccacttttctgaatctgtgccccccccccacattctttcatcaactttaatccaaacgcgtacaatcagaaaaccccactaaagcggaggtagaatcccattggtttttagcataatcacatggcgggaaaattgttaccaaaaaaaaaaaaaaagagcaaaaatcttacctgaaaaagacacgtgcggtgaggtagtattgctgaatttggcttgagcaatattaaaatattaagactattccaaagagtttttcggacacgaggctttccctgatgtgagtgtgtggattctagaccctgctacaagtcacgcccttaactttcttttccgctctagactgcagtttattacccacgccaggcttattgaacgctttgcatatctacctgtaacattttagccaaccatctctacgctatcccagacattttcatcacctctgctctgcccagcagacattttagtcgacctctaggggttggttataaggcagggattttagcgatctccccaggtccctggcggcggcaggcattttagtgatagcccaggtccccggtggcaggcattttagcgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccaggtccccggtggcaggcattttagtgatagcccaggtccccggtggcaggcattttagcgatcttccagatccccagtggcagacattttagtgatagcccagatccccggtggcaggcattttagtgacctcccagatccctggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgatagcccaagtcccccgtggcagacattttagtgacctcccagtaagcggtggcaggcattttagcgacctcccagatccccggtggcaggcattttagtgatagcccagatcctcgacggcaggcattttagtgacctcccagatccccggtggcaggcattttagtgacctaccaggtccccggtggcaggcattttagtgacctcccaggtccccggtggcaggcattttagtgatagcccagatacccggtggcaggcattttagtgatagcccaagtaccccgtggcagacattttagtgacctcccagtacccggtggcaggcattttagtgatagcccaggtccccggtggtaggcattttagtaaagtctcccagtcccaggcatccatttgagccattagtccgggaacgtggcatgtatgttagctatctttccaggtccctgaccggtagtctaaccacctgtaagggacagacattttaaattttggctccaggacccagcagacattttagttattcctccgttatgcggcaggcattttaactatcggttcgggactacgcaggcattttaccttcatctccgcatagctggcaagcattttaggaatctttctgctgcttggcaatcactttaaccatctcttccgctgtcccgcaagcacgtagccatcgctccactgtcctgaaagcactttgccactgtcccactgtcccgcaagcacttagccacctctcccctgtcccgcaagcacttagccatcgccccactgtcctgcaagcacttagccatcgccccactatcccgcaagaatttcagccacctctccaccaccccaacaaggacttcgggcacctctccaccgtcccgcaggcactttaggcatctgccctctccttagcccgcatctcacccaccgctccgctctggccacctgtctagctggctatcacgctcttcttccatcacgcgcttgccgcagccgcctcccgggagtggatgcaggactcaagatgcgtggatatctcggaaagtgagaacagagcaagggcgccgagcgcaagtgtgtagcgcttgcaggtacttttgggaccgagtggagcacgacgtagcgcctcaccggatcttgcgagattgcgcctgacacaagcgctgcactgagggtttgagggagtgtggggcgggacctaaggctcttgaggcgcgggatcctgctgagagggtgtggttagcacacttgaccacctgcgcagagaagagggggcagagcttaggggaacagagcatggaccttgtgggagtcacagaaaagaatggctgcaacctgagcccatttgcctttgagagctgggaaagctaggccagcaggtagcagcttgcctggtcgaatggcccttggtgagtgttggaatgctggaaacccagagaccaaagctgccaggctcagctccaacacagtctcatttgtttggtttgtggcagactgcctgcaccccaaccctttcctccccagtcttgcctcctcctgccccctctcttaaactcttacggtctcaaagactgggtttgagggaaacctactgtaatggattgatatacttctccttcaattgacaagagacttaatgtcctagagaaaaattttccttaaactgtacatatccaaatttcaaaaaatgtataacagtcagtatcaatgcaaactgagcaatctgcctaggtacctataaacacacaagatacctataaacacacaagatacctataaacacacaagatacctataaacacacctagatacctataagcacacaagaagcttatagagcaccaattagactggaacagaaaagaaaatcctcctgccacataataacccaattttcttttcaaagaattttttaaaaatatttttattttatgtgtgtgggtgtgtgcagagcccatagaggccggatgagagcatcagatctccctgcagctggaggtacaggcgtctgtgagctggtactcgagtgtttgggaatcgaacctgggtcctctgcaaatgcagccactgctcttagccactgtaccatcattttaaccccaatgtcaattttcagtccccaaagctttgctggtatgtgatacaaattttataaaagtagaaaatgaggagaacttctttgcaaagaaataggatgtagcccaagggaggaaacaaaaaaccctctgagtgaaaaaggcagattcttcaagtaaaatgaatacaaaaatccccaagaatgtgatattttggcaaaagccctctataccatccaggtctgaaatattaaaagaattagagcctttcaccaggtggtggcggcgcacgcctttaatcccagcactcaggaggcagaggcaggcagatttctgagttcgaggccggcctggtctacaaagcgagttccaggacagccagggctatatagagaaaccctgtctcgaaaaacaaaaacaaaaacaaaccaaaaaaaccaacaaaacaaaacaaacaaacaaaaaagaattctagcatctttcacatacaaaagaaagtaccgaggaaaagctggaatggagctctttcatgttcttccttgagttctttgaactgaaacaaatgatggaaaatggcttctccccagaagccatcaattctcagtagaaattcaagaagcccattcatgaaaattcatggaaggccacaggaagctgcacccaagctaatcacctacctttgccaagtatactgaaatagctccatgttcttagtatgtctactgttccgtgtgcttggcacaggtctgtaattgcagcacttgggtgtatgtggtagagagagacgtttcaggtgttcagggttatcctctttggcgatatagtgagtttgaggccaggctaggatgcatgagaccctttaattcctgcacttgggaggcagaggcaggaggatctctgactttgagaccagtctgatgtacagaacaagttctaggacagtcagggctacatagagacaacaatctgtctcgaaaacaaccataaaacaattgtgtgtgtaaaattattaaattattgagctttctaggaatttaaagctttaacagtgagatactttgcttttaaatatcaatgcccaattcattcatatttcttcaaatgaacgaaaatgaccagtatgcatatgttgttactggaatgcattctttttttacctttagaagatagaaagtaatactccaaaatatttaataaaatattttaaagatggatgctactagtgattagtattataagtagttgttaactgataacattgattacctaacaaaagttgactgtgagaagatagcatttctaggatgtacaggagaaaacatactgatttctagaaactatcaccaaattttaaaaataatatttttattaattctttgagaatttggcatgtgtactatatcacccccattcctttctctaaccccttgcagatccaccacctgccaccctctctcaacttaatctcctcattaaaaaaaaattacccacagtgtccaatttgtgctgcacgtgaatgcctggatgtgaaccatccactggggtggtgtgcctaccaaggagtcaaaaaaccgtgactgtccctctcccaaaagctctcaactctaaatagtgcttccttatgcttggaatggcgattaacacaagcttattcaggcagctacagttcacaagtacagcagttaatgtcctgtcctgaaggttttgttttgctctggtccggctttgcctatacatcacaaagtctgtttcttcttctgccatggtcactggtccttggggagaggggactgcttttgaaaatgaaggtcatgaatcgacttcaggaggcccattgaacttgtgaaacgttgtgctcaatatttgccctgtatatgctttgcagagaaagttttcttgatgctgagaatcattggtgtcagagataaatccacagtctgtaaactgttgactgtagctctctccttacttagcatatgggggatgtggttattaaatgttttattgtatgcttttcctattttgttttttggagtaatttttggcaggaaaaaaagtaataaaatgaagagtttgaagttgaaaaatataaaacagcaaccaaagggaaatactcactttagaaatgagtacattcaaatatacctgagaaatcattacattaaaactatataaagtaaagccaagtggtgatgatgcacacctttaatcccagcacttgagaggcaaaggcagaagcagagaggcagagagaggcagatgcatctctgagaattcaaggccagcctggtctacaatgcaagttccaggacagccagggctgttgcattcggaaaccctgtctcaaaacaaaacaaaacaaaacgactaaccagtcaacaatagataacaacatcatgccctgtataaaatacctacaagttaatgttaaaacacaagtcaatagagtaggggaaaggcagtgtgcatgtggggagtactcatatgtccaacaaaagtaaaaatttgccagaatcaggtgtttgtttgagggaggggaatctcaggaagcttgggatatcttgttcaactcatgctcctgcctccaccattcaagtgctagcagtataagccttcttttttatttatttatttatttatttatttatttatttttattagatattttctttatatacatttcaaatgctatcccgaaagttccctataccctccctccgccctccacccctacccacccactcctgcttcttggccctggcattcccctctactggggcatataaagtttagtataagccttcaataacaaacatgttcggccccagaatccccatattcaaagctctgtaatgtagcaaaaagtccacaagatggcgatagagacaaggtgctaggttaagtagaagaggaagttcaaggccctcttttccgcagggaaagtttgtgaaatttttcctggtccttgctctagctctgtctggtggaatgtaacaacgttggaggaagcagtttcttttttcgggaaggagaaagatctagggatatcacgctcattactttctacacttatctgaacgctatctggagtcagaaatcaaatagctgagcgcatttggatagcagtgatcaaaactctggaaagagaaagtatactgcaggggaacagcgggctgctaagtaggtgtaggtagtccctgctgaataaactaaagtagccaacgacttgaaaagaaatagagagatctgcagagaatttaagaggtttaaaaggcactgtgtacacatgtgctgattttggaacttcctacaaagctgcacgaatcaaaagtacatggaggggttggagagatggctcagcagttcaaagcactgactgctcttctgaaggtcctgagttcaaatcccaacaacaacatggtgactcacaaccacttgtaatgagatcggatgccctcttctggtgtgatctgaagacagctacagtgtacttagatataataaataaataaatctttaaaaacagaagtacatggaggtggatttgaaggtcagcagctcatattgctgatggagtttacttggagtagagtggaaaatgtggacataactgtgagtctgtgttctgattgttgcctcccagaagatcaactcagggcattaatgattgatccacttacatgaacttcctcaggcagacatttaaaaattaattatagtgttgttatctaggttatgacaacatagtcaaagccagcaaaagggatgctttgaggtgacgataggggaagatagctttgaaattttgtttctacgcattctgggggaactacaaagtcatctatgtgcccattactcaagtcatattcaggagaaagggggggtggaaaaggttgaagtccttaatctgattgtaaccagcttctaggttcacaaaggcagtaaggtgaaggacaggacaacattgaaaactgcctgcttgccgggcagtggtggactttaatcccagcacttgggaggcagagacaagtggatttctgagttcgaggccagcctggtctacagagtgagttccaggacagtcagggctatacagagaagtctcatctcaaaaaaaaaaaacaaaacaaaaaaaaacaaaacaaaaacaaacaaacaaacaaacaaacagaaaactgccttctgggtattaaaagtgtgtttcaacgaacatagagcccatctggagagatagctttgtctcccttctttttgaagtttcttttttatgtgttttggtaattaccagcatgtgtaccacctgcatggctagtaatgtggaggccagatgcttgagtcagatcccctggggctggagttacagacagctgtgagctgccatgtgggtgctggaaacagaacctaagtccttcataagatcagccagtgctcttagccactgagccatctcttcagcccctttgtatcacatctttaaggaaattctgtcaagtctagaaaacagacccccatggccacacacaacaaagaatgcggattttataaaaatttacacctcaaattccaatatgcaaacacacttcaagtaaatgagcaatgggcgtgtgagaaatctttggtatgggacaagcccacacagggtgtccttgcaaggacattctataggtctcagaactgagccttcgttatgctgctggaagccatctttatctagctccgttgagtgagagtttgcttgggaacagacctggtgataattatgtaacaggcagaaactggctgaaggtgctgtagcaagtgacacaaataaacttgttcattcttggaggaggggagcagtggggtcaaaactctgagaaagaaaggacaatctatttcccaagtggcaagattataaaattcaacctgtcacagtgacaaccaaaaatgacctggtaaacaaataggaatttaagatttgtacataagaaaaatagagccttcctgctcataatgtagatgtgcagcttggccttcatgtggatcctgaactactggaacactggaacgggggctatcacaaaagctgttgcctgtccatgggatttgttctcctagctgagttgcctggtgggcctcagtaggagaggatgcacatatcctcacagaaacttgatgtgtcagggtgggaggatacccaggggccctcaccagctcagagaagaatgggagggagaaggaagaaggatcatgggagggggggacctggagttgggggcagtgagcaggatgtaaagtgaataagcaaaaaaaaaaaaaaaaaattgtctcctggagccaggcgtggtggcgcacgcctttaatcccagcacttgggaggcagaggcaggcagatttctgagttcgaggccagcctggtctacagagtgagttccaggacagccagggctaaacagagaaaccctgtctcgaaaaacaaaaaaataaaacaaaacaaaattgtctcctggaaatccagaagaccagacagaagatagtcaaccaaagaaaagacttgagtgatactgtaatctgactgtataacacagaacaatacaaaggcataacagtaggaaagcaagcttctcattgtaggctcggtcttcagggaagactgtatcctagggcaaaaaccaagtgtttcctcgggatgtgctaaacctggtgctggcccagtatcctctgcaatgatagaattctacctagactgctccatttttcagccagcctctattcagctagactccagaaaaacaagttcagtgtttggtgttttgctatttggtcactaggtggcagtataagcccaggtttgtgctacagacttaaagccataaaaaggagcttggttggtcatatttttacaaatacaaatatttgtagtaccttggatgactttagatggatgcagtcctctgcagtgatctatactatagtttatatgtaactccaattaaaggcatttcaaatcagactggattagcatggatacatttttgggctgttagctccgttctattttgtttacatatgtttcttttttcactcttagggaaactcattccaacagtcccacagcttcttgtcagaggtcctcgataaatattaaaaggttgaattgaaacacagcaagttgtaacacatcacacacatgtatacatatatacatgtatacagcaaccatatgctagctcatagcacatggtagcccgcaaccctctataatggcatctgattctctctttcattgtccatgaagacagagaacacatatagattgagtaaataaacaagtaaataaatgatctttatacacatacctctagggaaaacaatatgaatatagctctcataaattctcaaaaacaaatttaaaaataaaaaaagaacttaaccacatagaattatactagaaataaaagcaaaaagatatagggaaaattcacaaatgcatcgaaatacaatttgcctaaacatccaaagaatgaaagaagggaaattataaaatatgaagatggataaaagcatctcaaagtagcagcagaccagaagttgtagcatggagtaatagttgtaataggaaatttatacttgtaaatactgacataaaagaaacattaaaaagacagttaaaaaaaatgggtgctgtaaatctgaccaagaacccacaacttggacactcaaagacccttggggtgatagtggtggaccatccattattattttgcttatcagacacatcgtctaactcctctctaaatacagacctccaacgggagaggctggctcagtggttgagagcactggctgcttgctcttccagagcacctgaatgcaattcctagcaaccacatggtggctcaaagcacatggtggcccacaaccatctacaatgggatctaatttcctctttcattgtccatgaagacagagaacacatatacattaagtaaataaagaaacgaacaaataaatgatcttttaaatgaatacttctagacccatggattagggtagctctcagacctccccagagacacttctttgtgtagtgaccagggctttgatgtggtcaaaatggagagaatagtatctgtagagtgtgaagggtgctcagttctaaatggagcatctatatcacacagttacatgcaaacctcagagaaaatcacttaagacaggggccatctgggctgggggttaagcagcagtgacaggaccggtgctcaggagctcacagcagctgtgattccaatactaggggaggtactcgatctaccgctgaggagccattgggagttaatggtgtggccctctgatagatccatcaacctgcaatggatgaccccatctccatgcatatatggttggttggcacaaacgggacccagtgtgttattaaaaaacaaaaacaccattaaaaaaaccaccacaccaggccaaagccatcatttttagcatcacaaaaaaaattgaataaaatgaacaatttcttcgactctatcagggaaataacattccccaaattacaaagtctcttagagagagcagcgacttgctgatgagtgagaaaacagctcctgtccacagacagtgtgaacacaggaaaacaaactgacgctttcttggaaggtttgtttgaataaatttaataataagataatccaggctatatccagcgagcaatacacttttgtgacttttcttcataggagccctagagcatgttttttagtgaaaatgatctccatagggattggaacagaaagagaaaaggaagcattctgaaacacccccatagcagtctgctctcctagcttcagcctcagacaaacgtgactcattagaaattcaagtaactgagtcccttaatccccaggctgacatgcaactcctgagctcgaacattgccccaccttagctttcataagactcaaaccgacctgaagggagggaaaaaaaagcccaattctagcccaccacgcttctgcttaaccgacgggaaggaaaactgtacaagacccaagaagaatcgctgtgatgaccacagttgagtggcatagatacagctaatgaacaccctgccaccatcaaggcctcctgtaatatcagagaaatacaataacgtgtcatacaactcagaactaattcaagaagtctctagagcaaccaaagcaacaaattaggaaaaataaagacacttggaacattctccaacctgggatccctctggctgtatcaaacagtggacacatggtatagccctcattttcaaccacatcaaacactgtatgtaaagcttactaaaacaaaaaaatctcagctagaaaatacagatcagaaccaaattcaggcgtggtagacatctgcaaggattagatggtacatctaattatgattaacatggtaaaagtgctaaaacaaaacaaaacggtagactggttttgacccccggacaagggacagaagtgcttattttacatatcaatgcagacctggcttccaggttctactagcagcgttcagtccctgcctgatataccttgttcccaaccttgaactttccagttcaggggcttagctgcccttccacaagacgttctttccaatgttatctagacattttgcgccccacccttctcctctctgcacgagcgcaccccttcttcccttttctcctctcccctctccccatggcaactcctcaatccttgaagccagtgaactccccgagagcagttccccaataagcctacctttaatgcaatcggacttgaatagtctcgtttcacgggcagagaagtcattgatcggagacaacatgcatgaataggagaccaacaccatcaacacaaccgatgctcaaaatcaatagcattaagaagtgagcattcataaagatttggaagctaacacttcagagcacactccagaagaacaaatggggtgtgaggggaagggatttagttagggattttgcttgtcattggcggtgcatctctgcaatcccccaaatctggaaggctgaggaggatcagaagctcaaaggctgcctggaatgcgtggggagaatctccctctaccaataaagagacaaacaatgccagacaagcagaatgtatcaggagacaactggaaatgggataaagatacaagataatacctaaaacctaatggaatgaatgaagctaaagccgcacaaaggtgtgtgtattggggggtggggggagttacagatgcgcattcctaaggaaggaatctctgagtcaccaccacctgcaggaaaaccttggcagaaaacagaaatgacaaaggctcgagcgtaaatacaaaattttaaaatgctgtttttcttgaaaaaaaattttttttaagaagctgatgaaactaagctacaccaataacaaactcaaatcacgtttgcaaaaggagaccttacaatcagtcaatgcttaaaatctctcaagagccgaagcagaagggatgctatctaactcaattcatgatgccagagtgatcctgatatcaaagccagaaagagacacaaaagaaagttaaaaatttatagcccacatccctgatgatcatcatcattacaatatccataacccgagtttgatggaattaaaatatccaggtgggatttactcatggaatgcaagaatgattcaacatacaaaaatcaatgaacacgatatcaccacaatacaatgacgatcatcttgatagcattaaaacaaaaacaaacaaacaaacaaacaaacaaacaaaaaaacccacggggctggggagatggctcagcggttaagagcaccaactgctcttctgaaggtcgtgagttcaaatcccagcaaccacatggtggctcacaaccatccataatgagatctgatgccttcttctggtgcatctgaagacagctacagtgtacttacatataacaaataaataaattaaaaaaaaaacacttggaaaaactcagtgtactcatgattaaaaactctcggtaaaccaggaataggaggaaattgtctgagtacataagggccacattgaaaaagcccacagctaacatggtcaatggtgaaaaattgagtgctttccctttaataagatgaaggaaccaagaatgtttgctctcttagattccaatcctaatagaattgatggtcctgtgcagaacagttggggaagaaaaggaatccagggctgggactgtaccacagtctgtagaatgcttttctctagaatgcataaagccctatgtgcaatcccaatagtggtacaagcctatgaccctgatactcaggacgtagaagctagaggatcacaattcaacgttaccctgggctaaagaccctgttttactttattactttttttttttttaatatctgaattgtaactgactggagtactctgctcacaaatgccatgattatttatgtgggggacttacgaaagtctacacacacatacacacacacacacacacacatacacacacaccatacaactcaggtaattcagctgtaaagttataggatacaaaatgagtatataaaagtgaattgagggccactgagatggctgagcaattacaaacacttgcccccaagtttgaagacctgagtttttgtttgatacagccctggctggcttggaaattactatgtagaccaggctggctaccaatttatttaagatctgtctgcctctgcctttgagtcctgggattaaaggtgcaagccactacagcaaacttggtgttatagtttaaatatatggtttactcctagcaacttgtatgttgtcttggtgctgaaatgtggtggcatctttaagagggtttaattaatttctcaagagcctagctgagttcttggattttaagaagaggttgctataaaatgatcctagcatctacctgatagctcttgtgcatatattatactggacaaaatagatgtttccctaccacaactctcctatgagttaacactgcttccaaccagaaactgagaaaatcctggccagcacagtcttgaatgtctctgtttccagaattgtgacctaaatttatctttactattcatgacttaatctaggttgaggaatgttgctataacaaaaaataatctgagataattgctctgactagaacatttaatattgttaaaatactacttctgttcaaagtgatctgtagagtcaatcaatatctatcgcactcccaatgggtttttgtttgttttctttttgtattttggaagtagcaaaaataactataaaatacatatagatgcgtgaagacccatgaacagccaaaataatcctgaaaaagaacagctcttgtccaatggaccttgggggaaaccaaacgtcacattttacacagagcaggataaggtattggttttcattttgcctctccagaacacaaaacctagatttttttgtttgtttgttcatctgttttaatagggcctcatctttagcctgggcttaccttgaatttggagtctgcctccctcagttgctatagttctgggattataggcataaggtgcaatttccagcaaaaatcctttaagggctgcttgaaactcactatgtagctcagcctggcctcaaactcataaccatcctctcaagtgctaggattacatgaatgagccacagtagcagctaaaaccctttacattttattagggtatattctatacaatatgagtgccattataacatcacatacacgtaagattttgttcctattcactcccattactctctttttttctccctctcacttttactgatccccttactctgctcacacacttctgatttctggtttcttctatagcatggatgaagggttatttacaggaacatggcagattcttaccgaagaaagtatccccccctcccaactccctcagcaaacaataactactaataccccttctgcagggaggaatgaggcatcttggtcccttacgtctagacactgttaactgcctcctcggggagggatgaggccttgtgagcctcttgtagcaactgttaacttcctacacatcctaaggaatgtgggggtccccttgtatacacaggccttgggtagggtaatcataggtgctgtgagtttatgagtatgactgctgctgtatgttccacaataccccatcccttcttccagctttacctttctgccctctttgctgtggtgtttcttgaaccttgcaagggaggagatgcagatcccattagggctgatcttcaacaatcacacaatcacatattcttttttgtttgtttgtttgtttgtttgtttttttgagatagggtttctctgtgtagctctggctgtcctggaactcactctgtagaccaggctggcctcgaactcagaaatctgcctgcctctgcctcccgagtgctgggattaaaggcacgcccagccaatcacatattcttatgactcagagctaaaagtctgcacgaacagaaactagtcttaccaaagctgacagtagcacaaatctacaggtataaacatacatggttagaagacaatttgatagtcataaggtggccagctagggaggcaatagtggtaaagcttctccattagagcctatggtctccccagctagaggcttttgacaaggcatgaactttctcctagcaagtgagcctcaactccaatcagaaagttaattagccaaataaaaaaaatggtaccctgtgctcagcttggcctgtgagtaaatctgtgggacattttctcggttaacgatcgactgggggggggggcagtccacttaaaccatgtgggtggagccacccatggacaggtggtcctgggaggtatgaaaaagcaaagtgagcaagccatggggagcaagccaggaagctgtcctttgtggttcctgccctaatttctactgtgatgtggaagtacaagccagataaatcctttcctacccaatgtatttttggttagaatgttttatcacagtaatagaaagcaaactaaaaactaaaacatctttctaactttcatgccacagtttctttttcttcctttcttttttcttttctttcttttcttttcttttttttttttttttttttggtttttcgagacagggtttctctgtatagccctggctgtcctggaactcactctgtagaccaggctggcctcgaactcagaaatccacctgcctctgcctcccaagtgctgggattaaaggcatgcgccaccactgcccggctgcatttttttttttaaattaaaaaagttgaacctaggtgtgttgtctcgtgcctgtaatgcccatgttcaggagagagagagagggagggcagggtgattactatgacttcaacatcagcatgcgcttacatcatcagttagaggccagtctgggatacagagtgagaacctgtctcaaaacaaaaacaaaaaaacaaaaaacaaaacaaaacatcaactatcataagtgacttaaataatggatattaaacctaaatatcacacaacttcacttaagaaaattctgaggactggaaagatggctcaatgattcaaagtgctttccggaggaagcctgaacaccacagtttgagtcctaacacttttatataataagctaagtgtgggcccatgcatccctataagtccagcactgaggctagcagagactggaggattaacaaggcaaacaggcagacacggtaacagcctcttcatgcatgcactagctcacacacatgagtgcgcgtacatcacaaacacaagcacacacaataaatacatttaaaagttttcttctttctttgtaagtgtgaaaattacaaattgtagaattttgatccagataagaggatcaggagtttgaggctagcctgggctacataagaccctgtttcaaaaaccaaactaaaccaaaacacacacacacacacaaagttgacacaaattttcaccatgtattcgacgtgtcaaggctcacctgggtcatgcaagactaaataaattaattgtaactaaatgcaagactaaatgtctaaagtatttttgaaagtctggcttaatgcaatttgcttcggtgttttgtcagatgacaagttagataggtcattccatgcttgtttacgaacaagacaagtaaaatttctcgagtctctgtctcttggaataggtctttccactgtaggtgggagggaaatgtttccgtctcccaagtgctggaatttaaaggtgtgggtctggttgaactcgttttttgtgtccttcagtggtcaggtgccccggctggtgggtggggtgggaggaggagtatctgtctctattgttcctggactgatcctgaagtgtaacggaagtgaaaggaaggttgagtggagggctagtggacagtgactggcccacaacactacctttaagaagacaaatggaccatagtgatgtacacctataatcctagcacccaagaggcagaggcaggaggatcactgagttcaaaaccgtcctgatctacagagagagagagttcaaggacaaccagggctatacagagaaaccctgtctctgggggggaaaaaaagcaaggaaaaaaggaaggaaggaaagaaagaaagaaatgaagagaaagaaaaaagactaataggtcccagagactcccatgacagtgggaaagaagagtctgcacacttcctcctgctggaattcttgataagaaataacctccagagaaatggcaatcatttacaatttataccacaaattatactacactggaacaccatagtaggccttaggagaaaaacagacgcttaaacatccctacttggaggctttttgaaaacaaagtaaattatctttactgagcaagaaaacacttggtgtctaggtaaccctgtagcatgtgtgaaacaaaagactattgcccagacagagcctcaactttctcctttctattaaattcacagtaaaaagcaaacatgtatagacataagtaataaagtcaggtgtaggcataaatcaccgcatcttttctacaaaagtgagcttaagcgttttacctttttaggacagagtgaaaatccggaagttgtcttctgattgttacatgctgccacggtcctccctgtcactgctgccattgggctatggcctggtgtctgtactcaaactgaaaacttgcaagctagcacacgtgctggcggagtgtggacgcacgggtacacgtgcgcacgcatgaacacacacacatgcacacacgcgtgcgcacagacacacacacacacacacacacacacacacacacacacacacacacacacattttgcgcatgcgtacagatatgtgcgtgcgcacacacatacaggcacacgcacacatgcaagcgaataaaattaaaatatggtaggcgcatggtagaacatgcctttgatcccagcatttggaggcagaagcaggcagaactctgaatttaaatccaatctggtctaaaatatgagttccagttcatccaggaccacgacaaaaagaccctgtctcaaaaacacaaatcacaaaatggcaaaatgaaacaaaacaaaatgaaaaccaaataaaatagaaataagaattctaccttcagctgagtgtgtgtttgtgttatatatgaatattgtgatgaatatctgtaatcccagaactgaggactttgagacagaagaattaggagtttgaagccagcctggaaaagatggccagattatgactgtttttctaaataataagtaaagaaataaagaaaaggagaataacaaccaagcatggtgataaattcgtgacctcatcttctatgtatatgatgtaaaagtcatgaagtaataacctcttacaatattcaagtagtagctttacttggaaagaaagattttaaaagaaattttattttttagacagtcaaaaatataattaagaagtatcgtatctgtgctaagcagacaatataaaattcgggaacaaagaacatatatctttatctgtttgcttatttttatttatttatttatttacttacttacttacttacttacctacttattggagacacatttttttctatgtaacagccctcactattctggaactctccctgtagaccaggctggcctcgaactcacagagatttgcctgcctctgcctcccaagtgctgggattgaaggcctgtgccatcactgcctggcactttttctttctgtctctgtctctgtctctgtctgtatctcttccttcctttctgtctctttcttttttatctttagtatttttaaaggcatgtttttatctgctagctatttatttttgaggtagagtctcacgatacagcctcaactagcctggaactcagaaagagccatcttcctccccccaccacacctggcaggttccttttaaagacattacttctcaactcaaataatgctaaaatcaattgagctgtttatcatctgactattgttggttagctagaaacttctgaagtgttgcaatgtttagctaaagtctagaatttgctgtttttccatgtgttaagtgtcaggaaatgcgaggtaggtaagtgtttgaagatagtgtctgccattatacaaaatgctgagtgataggctgattgagtgtacaaccaaacagatccagatagtcaccaacttatttattagttgctggactggtttttaccaaactatgaggaaaagtaggagggataaaaaagagtaatagaggggtgaatatgcaattatgttatatgcattatggaaatagttaatgaaatctttactttgtacaaatagtatacactaattaaaaagatacaaatagctgatatgcaagataaataagttttacagatctaatgtatacatagcacaggcactacagttaatgatactgtgttagatcctttttaaagaaaactctagttttgctgagcgtggtggcacacgcctttaatcccagcacttgggaggcagaggcaggcagatttctgagttcgaggccagcctggtctacaaagtgagttccaggacagccagggctacacagagaaaccctgtctcgaaaaaacaaaacaaaacaaagagtactgactgctcttctagaggtcctgagtccaattcccagcacctacatggtggcttacaaccatctataattccagttcttaggggacattgacaccttcttctggcttctgtggacactgcacagatatggtacctaggtatggcagccaaaacacccaagcacataaaataaagataaataaatatttttaaaaagggggatgggggtggacagatggctcagcggttaagagcattgactgctcttccagaggacctgaattcaattcccagcaaccacacaaccatctgtaatgggatctaatgccttcttctggtgtgtctgaagacagctacagtgtactcaggaaaaaaatagtttttttttttttaagaaagaaattcagatatctgctgtattgtactctttattactgccaggacaaaatgtccagaacgataattcaaaaatagcccactgacttttcacgtgctagaaggtagaaagtgatagcagatttcatgccatgcagatgatccctgtttccacagaggtgcttctctcacaagacagaagaaatggaagagcaaaagacacaaccaggagtgtacttttagctgttcttacaaggacagggacagtaatcgagtcatggaggcattaccaaatacatccaaaaaggccttatctttcttgttgtttttgttcggttggttttggttttgaggcaaggtttttcggtgtagttctggctatcctggaattctggagtcaggctgacctcgaactcacaaagatcctcctgactctacctcctgagtggtaggacaaaagccgtgcaccatctgatcaccctactcatgatgtgtgcatgcacacacactaataataacaagcaaaaaatatctttaaaaagtctaaaaccacaactttgagacagacattaggtagacatacttattccaaaagtcagaaataggaaagaagaaagggataaattacgccaaataagccccagacatggcagggcaagagttcgttctgtgtgcgcacgtgctccaaagtgtttcattacagttgctttcagagtcctgggtgaggggattatttgtaggagaatggactccctacaagtagttacacactcagatcttctctccctttctcaccaactatagaccccccagggaggggtggggtaacatcagctcctcccaataggggaaggttttgttggtgttgtgttgtgttgtgttgtgttgtgttgtttgagacagtctatcactatgtagcctgattggcctggaattcatcaggtagaccaggctggcatctaaatcagagattcacctgcctctgtattttgactgctgggattaaaggtatgtacaccaacatattcccctaagaggggatggatcccagggtctagatgccattgctctctctcccctctctctttataaatatagttttaagatttttacttgtatttatcagtacagggggtgggttgctggagtatgccagaagagagtattggatcgcttggagctagagttacagggaattttgagacatctggggactgaatataagtcccctgaggagcagcaccccaacatggtaatacttcatcttaaggctcaagagcaaactttggctccaagttctgcctctagacacacggagcgccatttgggttcacagggctctaagcttgcctcgctaggcacgctgacacagcacttcttgtcagtcggaaccagttgctggcacctctcccaagctgtttttgcatactggtggctctatagctctggcgtcataactgagagcagtgttttcatagctcttttgggcattgctctcattgggggtctattctctgggcaaaagtcgctaagcactgtgctggtagagactttatatcagccttcctctggttctctgcttggctctcaaaactcatggaggaatcctttgaaatctaggtgaagctagtcatgactccacagctcatacgtttggaggcagcagttccttgctaaattctactttgtgtgcattaatgtctcctaagcaagtctagtagaaaatcctttataatatcaattgtagtacttcaagtttcttccgcatcacggcatcggctgagtaacagtcccccagatagatggaacaatagaagattacaaagtgagaaaaggaaggaagtagaaaaactggtgtttacttggttccagctgttttctgattcaggaagaaaggggccgggcatactctacccatttatagtaagaagatttttttgttttggtgggtttttcgagacagggtttctctgtgtatccctggctgtcctggaactcactttgtagaccaggctggcctcgaactcagaaatctgcctgcctctgcctcccgagtgctgggattaaaggcatgcgccaccatgccaccacgcccggcttgtagtaaggagatttaactgtaccatgtaaggcaagagctcctcatgtcagagttcaaaaagtaaatgtgctgaaccatcacttggtttagaacagcttaagcccccagcccccactccaccccaaaccaacccttgactgtttaattgctgataaggaataaaagccctttcctataaaccactgtttgtttgtttgcaacgaaatcagagatttactatatggatatttaaaaattcagaatttgggggctagagagatggcttagaggttaagagcactggctgctcttccagaggtccagagaacccagtttcaattaccaacaaccacatacagatcacagctgtctgtaacttcagctctaagggatcctataccatcacacagatatggatgcaggcaaaaaagcatcaatgcacatggaataaaaataaataaaatttttaaaatttggaatttacaaataatgaagatccctcactggttcagccactcaccgaggtacctcactccagcaatttcccctcaccagacttattcatttttaaagtttagatgtttgaatatttattgtaaaacagcaagcacaatgatttctatttttataattggtgacgtgatctggaaaaatacttctaattggtaaggcaagagtgattgcaatgcactcttcatttttttctaacttcttaaagtatcttcttttttaaaattaaaactttattataggggctggagagatggctcagtggttaagagcactgactgctcttccagaggtcctgagttcaattcccaggaacctcatagtggctcacaaccatctgtaatgagatctgatgccctcttctggtgtgtctgaagacagctacagtgtacttagatataataaataaatctttaaaaaaaacctttactggaaggagttacagagacaaagtttggagctgatacaaaaggatggaacatctagagactgccatatccagggatccatcccataatcagcctccaaacgctgacaccattgcatacactagcaagattttgctagaaggaccctgatatagctgtctctagtgagacttcgcctgggcctagcaaacatataagtggatgctcacagtcagctattggatggatcacagggcctccaatggaggagctaaagaaagtacccaaggagctaaagggatctgcaaccctataggtggaacaacaatatgaactaaccagtaccccccagagctcgtgactctagctgcatatgtatcaaaagatggcctagtcggccatcactggaaagagaggcccattggacatgcaaactttatatgccccagtacaggggaacgccagggccaaaaagtgggagtggggggaagggtatgggggactttttggatagcattggaaatgtaaatgaggaaaatacctaattaaaaaaaaaaacggggcctagcaaacacagaagtggatgatcacagttagctattggatgggtcacacggcccccaatggaggagctagagaaattacccaaggagctaaagggaactgcaaccctatagatggaacaacattatgaactaaccactaccccggagctcttgactctagctgcatatgtatcaaaagatggcctagtcggccatcactgcaaagagaggcccattggacttgcaaactgtatatgccccagtacaggggaaccccagggccaaaacgggggagtgggtgggtagtggattggggggggtgggtatggcggacttttgggatagcattgaaaataaaaaaaaacctttactataaaaaaacttgcaaataaaaaattacccaccggagctaatgaccagatctttaatagttttgttttttatattgttatagtgtttgtgttctcagcacacttaacaaaagcaacagaaaatataagaaattaatctactcaactaaactaattaaagtttattttgagacaggatctcactatgtagtcctgaactggaactcactatgagcagctggcttttaatttaaagacccacaggtttttgcctcttttgcctctggagtgctgggattaaaggcatgagccagcagcatcccagactacattttaagaaagggaaaaaagctggtcgccgggcatggtggcgcacgcctttaatcccagcactcgggaggcagaggcaggtgaatttctgagttcgaggccagcctggtctacaaagtgagttccaggacagccagggctacacagagaagccttgtctctaaaaaccaactaaccaaccaaaccaaaaccaaaccaaaccaaaaaggaaaggaaaggaaaaaacgaggtaattagcataattagcatgacaaggaaggggtagtgagaaacagtgacacagaaacgcaaaggtttcaagcagaatttattggaagtttggcaagcaacaaacaccctagttggcctgtagatgactttagattgttttgcggtgattttcattttgaagaaggatttccaattttcaaaacagccaggctcaaattaagtattttccatttattttagcagtttggtatagatttgttttcggcttagtgtgtagagatgtttgtttgtttgtttgtttgtctgttttccatcaggacttcatttatgcatgagggcacaatggtagctgatggtgacacgtttctgcctgcctgcttaatcagttgggttcatggcaccatctgtggaagaaaggttttcaattattctctatttttcagtaatgcctccctcgtgaacatctttagaaaaggggccttccaaggtctaccaagtcttatcgattctctctctgtgttttgttgtttgggaggtttttctgtgtaatggccctggccgtcctggaacctcctttgtagaccaggcagactttgaactcagagagatctgcctgcctctatctcctgagcactggcattaaaggtgtgtgctaccgccatccagctgattgcttatattaaagggcaaacatcagtgtttcagctatattagatgcctacgtgaaaaggcagtatggggctggagatgcagctggttaagttgcatgctgtcaaacctgtgagggtgcatacgtgtaagagtacttgccaatacaagcaatgctaaacagttaaatgtctgtttccttctttacctatggatgttgtcattggtttgctttgtaaactatagttttgacgctgtgaaagacagaaggcactacagaaactacaaaatccttttcctttgtgtgaaatgtgaaagttttaagaaaacttataaagaaattgcactgatttgattactaaacgtcagttctacttaatgccaagcttagccaataactatttacctcacttctttccaggaaaatgttcatggtattttattattattttaaaaattatatgtctctgtgtcacatgagtgctatatctgcccagctcttgagctgtttaaggtttactgtaaatgataaaagttgtatgttgggctagagagatggctcagtagttaagagcactgactgctcttccaaaggtcctgagttcaaatcccagcaaccacatggtggcttgcaaccacccgtaatgagatctgacgcccttttctggtgcatctgaagacagctatagtatacttagatataataataaataaatctttttaaaaacagttgtgtgtcttttatttaatttatacaagtgctagtgcctacaggggtgataggaattgggtctcctggagatgaaattataggtgattgtgagcagcttgacacaggtgctggggatcaagcttgggtcctcctctgtaagagcaatatgagcttttaactactgagccacatggttttagttctttataggagacactgttttttgttgttgttgttgttcttgtttttccccctccgttctgccaagtcctggagagtgttcgagaccgtgggtctattctatattctcagagctcaattgttctggaaagtcagagcctaagaggtaggatctcagaagtaggactggctgtggattggctgctcagctcttccctagcttctactccttcactgtgattgtagcttcagggattctggctccaggggcagcagtacagtttagtgcgatctgaacattaggaccctataaacttgtactgcttcagatcctcccagttccttcaaggtctcatttcttttttttcttgataactattactcacaatctggttcctacaggtgaaaaccttatctactccccagggatctcagctgaaccagcctgctggggctcctccttggccagattcaagagccttggacttggtttgttaacaaaggggagaggaggggctgcttatctggggatgtctgagtgggaaaggacaccagggacagtccttgagctagagtcctcccttgtggccaaagtacagtgtaatctgtgggaacagtgaccatttgtgtctcttccttacccttgatgttctttgattgcctagaccatcctcggaatgggatagggtgccttctgtctcctggatactgggattgcatcatactcggcttttgtagtactaaggactctaaccaaggacctcattcatgcaaggcaagtactataactagtgagctacatcctgattatccctccattgtcttatttattatttggttagttatttatttggtagggtctcactatttagccctagcttgcctagaacttgttatgtagaccatgttggccttgaagtcacagatacttgtcagttgcctctctgagtgctggagtgctaggcttaaaggtgtgtaccctagacctggcttccagtgcctttaaattccctgtatgtatgtcaggctgcaaggatgaaatgtgtgacttcaataacaatccaaagggcaagaaagatacctgattcagtttcttccaggtcttggtcagcttgtgggttctgatcagtgaacatctccctagaatatatagtgtaatcaattgtcaataggctaaatccaacaacttagagagacatgaaaatcattcatgcacacacatgaaaatatgacccatttatatttgaactaagacaggctatctacccccaccttctttgagacaggctcttactatatagtcctaaccagcctagaagccactatgtaaatcatgctctacgtagctctcaaaaagaaatctggaagtggcaatgtggtgaggtagagacggtgatggagagctcaaggccagcctttatcccaccagcagtctgggaggcagaggcaaatggaagctactatgtggagcaagttggcctagaactcctgcttctgcctcccaagtgctagaatgaaaggtgtgcactatcttacctgactatttttccattttaaaggaaaaaagacatcaaatgtgagcctccccctgccagagcctgacaaatacagagatggatgcttgaagccaactattggactaagcacagggtccccaatggaggagctaaagaaaggactgaagaagttgaaggggtttgcaaccccacaggaagaacaatatgaaccaaccccaagagctcccagggactaagtcatcaacaaagagtacacatggctccagctgcatacattgcagaggatggccttgtcatgcatcaatgggaggaggggcgcttggtcctatgaaagcttgatagatgccccagtgtaggggaattgagggtgggaaggtgggagtgggtgggtgggtgggtggaggaacatcctcatagaagcaggggagggaggatgggataaagggtttcgggggggagatgtggaaaggggatataacatttgaaatgtaaataaagaaaatatccaataaaaggaaaaaggaaaaaaaagaagaaaaaatgtaagcctccactagcacatgacaaatgacagtactgaaaggacagagcatgaaagttcttctctaggacattgcttgtactcaagagcagtcacatgaatacaaatagacttagggtctcttttactctttgaactctctgacttcctacaaaaatgagagccaggcccacaaaaacaaaatcctacataatttcataccaaaatcatctgtgagaaaaggtacacacaaaacagagtagacaaaaacaatctatcccataaaggaacagcagcatattgcaactgatgtgtggaactacagaccagatcactacaacactatgtcattacagacttcatcatcttcctacgttgcttctcaactgataccaaggataagactaagcacagttaatggataaccaactcctattgtatttctcctccctggatttcccataacccaagaacaattgagaatacatacatatacatggaggggcttgctttaatgttgccagtgatgactttcacattattgtctatgtctctgtcactgtgactggtttcatcatcttcagtacatccctatggagtgataaagacacaggggaaagtcaaaattgaagtagataatttttggctgtcaaaggaggacttttgtcttaatgttaaccctagagttgatagtcttaactgatgagaataaagttgggacaaagcttagtaaacagttgtaccttatggactactgcttctctcccacatcaagatcattagtgtagataccttgataagttttgagaaaatgggccttgggtacagtgttcttataatggtagattgctcacattaatgaaagcaccagataccctgaagaagtttgacttggttctagaatattttagtggctttggttgctgactataatcctcaattggcttttattactgctcacatttattttctttctttcaaaatcccaaaaggaaatctgaatgtggcagtacacatctgcagtcccagtactgatgaggtagaggcaggactgagggctcgaagcccagtttttaatcccaccagccctcaggaggcagaggcaaccagatctctgtgagtttgagggccagcctagtctacagagtgagttgtacagtgagaccttgtttcagaaataaataaggaaagaaggaggagtggagaggattatatctgtctaggtctcattcaccttagctccccagggctagtgtcctggcttcagggtaggcaaatagcagctacttggaaagaatctttactttggaagtaaatcctcaattttcatgtattctatattagcaaatttgcaaatattttaattgccttttggtcatttcagacacgcacagagaggtgaacaatttgtcacctggtttcagctctcaaactttaagcacacatcctctacattgttcatctaatatcacaatttccacatttacattccttttgctggcaacctccaccccaaggcatagtgctaaaactctatgcggtgtgtctaagcacacaaggctgtattgatgctgtgtcttgttcaaattttaaagtgtgtgtgtgtgtgtgtgtgtgtgtgtaagagagagagaaagagggagagggacagagagagagagagagagagagagagagagattggctctcaccttctaccttctctgggacagggtaagtcttatttctgccatgctgcgtagttcaggctaactggcctacaaccttccagaccattctgtctctgcctctcacctcaccatagacattctaggatcacacattcaaggcaccacatctggcttttaaaaacactttttatgggctaaaataccttttcacagacacacactttagaaaatgatactaaaaatacacagtgcgccagaagctgaatgacacacaataaggtagaactgtcaccgctctttctgtatactgtgcttcaataattcggccaagaataaacttgctacgtgtgcagttacactttagtttattcatggtatatactaccaaggaaaattttgggggtatataattaaacacattatcagtttgtttggatttttaaaaagctcttctcgcatacataacattctgactgcatttcccctccttccagtcctcctagttctccacccccagcccagccccatgagctcccctctcccccagatttgtttggaaacttttaaagtgaggctttcgaaaatggatgcactatgggctggagagttagcagagcacttagtagttctcactgctattccagaaggcctgagcttaatttccatcacccacattgtacaactagctcacaagctctttttgtttttgttttttgtttgtttgtttctgtttttgtttttttgagacagggtttctctgtgtagccctggctgtcctggaactcactctgtagaccaggctggcctcgaactcagaaatctgcctgcctctgcctcccgagtgctgggattaaaggcatgcgccaccacacccagctgctcacaagctcttataactcctaactataggggatcttctgggaaacaattgaccatcaattaaatacaatcttagcgtgattcagttttcagtggacatcattatcattatcattatcattatcattatcattatcattatcattatcattatcctagtaccatatctattgcatcatgtttagagcttatccacccttgacatttgtgttttttcagagtcccatcttggtgtgtttctgtcttccttggaccacttacagcttggcaagtgtcctcatcatcggtactgctgactctgtcctcctgaagaatatcttgcaggtgaagaaattcggcagcgctagagaaaaatgtcataataataaatacactggagagtcatttatctcaatgacagactacatgcaattcagaaaccgacatactaatctgttgcttaaagtaaaatcaggggccaaataaatgattgaataactatgatttacttcagaaaaatgccttgaacaaaatctaaaagctgaagcgtgtcacctagagtaaccttttcattgtatagattaaagaactgaaatagtgaggtgaatctgttttttgactataactttgttgcacttctactggcttacttgatatatgtattttgttccccaaacactttccttttaaaagcttcagttttggaattttatcaagtttgttcttgttttttgtttgtttgtttggtttttggtttttcgagacagggtttctctgtatggtcttggctgtcctggaactcactttgtagaccaggctggcctcgaactcagaaatccgcctgtctctgcctcccaagtgctgggattaaaggcgtgcgccaccacgcccggtttgttttttgttcaggtcacaatcaccagcctaattttgattcccaatattcttttttttttttttttttttttttggagacagggtttctctgtatagccctggctgtcctggaactcactttgtagaccaggctggtctcgaactcagaaatctgcctgcctctgcctcctgagtgctgggattaaaggcatgcaccaccatcacccggcgattcccaatatttttaacagaaacagatttgttcctaacagtagtccctaaatgatttaactatattgcaatttgggccctggatcatccacagtggagaatgtgtgcttttcaaggcagtctagaccaagattctacaagtaggtgtggctgtgcttgtgttcctaccctctgttttcatgaaacaaataggctacattttctcctagagtttctgggagttccattatcagttctctgggacactgtgcctcattcactagtcttagcaactagaatgcttctggccttgggaacatcccccatgaaaactgagtacaaaagagaaattgatatctaccatgttcataacaagggtttcagaacactgtgggaaataaaagtccaaagaaaattttttagtcttactgcagtaacacttttttaaaaaactcacagcaacttaccagtttcaatccacaagaagactaaaggctcttttctttttttggggggggggagcgtcatagattcccggctactgctctaggatgtctcatggaagtgtacatttctgtgctgagcatcaaattgtgtggcaaggtcatgcaagatgtatttcttgttcacttgggtggaaatcagctgctgacaccaaaggtgaccattgctgatgtgaagaaagtgttgcacaacttacctcagtggctcatctgcctgatcgtcggtgtcatcatctgtgatcatgaaaaatcaaatgtgaaagtgcagctaggaagcaaagggtggtagaaaggaggggttgggatcaaaggcctcttgagcttaaactgctgggtgcaggagactgctacctgctcaatgatattgttgaagctaaatacaacagagatttttttgtttacaacctgtggaatagttagttggagattggaccctttaaacaagcaagaatataaaaagaaaaaaaaataaaagttgtcgtttactaccttttttagtgttttaaattttgtatttacacataccaaaaaaatagtattttcatttattgttttgactatttgtaagtaaacttggaaaaagatcccttcagcattatttagcactttttcaaacacattaggttcttgaaatgggtgaaggaaaatgagcttaaagggggatgcagaacaaaaaggtacctgagttcctcttcagaccgggcccactccagcactaaaggagagaacccgagctgctgagttcattcccatgaaggcttaactgttgggttttggttttggtttattttttgtttttggtttttaaagacctagactgtcaacacataaataaaaaccaaaatgacaacaacaacagaagcaaaaatatcaaggtgggggttgggggtggggttccaaggtgcaatacttgcccagagcagaggacggcccaggctggaatcccagaactgcgaaagaaacaagagagaataaaaaggcaaactgaggattaaaacatacacagactcaaatgcaaataaaacttgtgtttaatgtgttagaagtcaaagcactttgaaaatatcctcacatgtattccatgttttaggaggtataggagcaagaatatatagattttatgggctgttatggaggaagcttaaacaactttattgatattttgtttgtttggaggtagggtctcactgtatatagccctacctggcctggagttctctatgtagaacaggctagcctcagagttaaagaggtttccatacctatgccttccaaggggctagcattaaatgtatatgctaccatatctagctcactttctgtttcttgttttgttttgtttttctcaatgcagagtttctctgtgtagtcctggctctcttggaactcactctgtagaccaagatggccttgaatttagagatccacctgcctctgcctcctgagtactgagattaagggcacgcacctccactgcccggcttcccgcgtactttcttttatttttttttatatattttttattacatattttcctcaattacatttccaatgctatcccaaaagtcccccataccctcccccccccactcccctacccacccactccccctttttggccctggcgttcccgtgtactggggcatataaagtttgcctgtccaatgggcctctctttccagtgatggccgactaggccatcttttgatacatatgcagctagagtcacgagctctggggggtactggttagttcatattgttgttccacctatagggttgcagatccctttagctccttgggtactttctctagctcctctattgggagccctgaaaatgaatccaacgtatatgttaaatgtcttagtttataagttttttgttgttcttgagtaggtccttcagtttgatttaggagcaataccagataacccacattcgaggagaacgtagaaagaagatggtaactgcaggctcatactggaacattctaatctataaaagacaatcctttccaacagtctaccacctccaggtccacatggttaactaacactgatttaattcattcgcaaccgtctgtgtcattctggttgcctccagttaaagggaatctctggtttagtttgacagctttggagaaaactaaggatcctaggatgatattacttagatatcaagggagaggtggcatgagaaatgaaaaccctggggagacaggagatggtttcccctttgctcctggggaatttgaaagaaacagtgtccctggactcgtgcccagaggagtcactttcctctttccggtaactataaaaaagtaagtaggtttttacctttgaaaagccagttttcttcatcctcgaattctggcaagtccattgcactgcattctgcttcagaggtcttggggctttgcttttcagacatagctccgggattcggcttctgtggagggagaccttgttggtggagctgatacccaagtctaggtgggtgctgtgaataaaggcctgagggcttgggccagagcttcaagtttttatcacagctcgtgctggggtggggtcaagttgagggggcggagtctggagagcctcgggtattgggaatgggtagaaccagagaatgacacacctctgtagtatcctaaatgcctatcttccatggaggtcttagaaaacattgacctctacattttccttcagctagggtaaaagtattaaggaaatctctgtgatctagtgagtattggcatgaaggagtaggtcctgtgtacttctttttactgatcaggtattagatcttccaaccatggagcttgtccttcccaatctacccttccagtttccagcacttgtatagaataggagggtgggtgggatcagcaggcagtggtgtaggaaggggacagtggttgggaaccagtagatgggaggtgagacctagaggtgaggaaatgggccaggagcaggcagggagttctgcagaactgtagtataagagaatgtcattgtactttatacccctatcctctaagggcatggaaaaaaactggagtctgacttttctctctgctggggtggaaaagcttaacagtatctgagcgaaggctgggctgtaggagccattcttatacccttcctttcagtgtgtcagatactgggattcccagagcttgactttatctatcaacaggcacagactgttagttcccagcagtattcaaggagcacagatggtgggggtgggcatgaggctggaaccagcgccatgacaggtggggctcgtggcagaagctatggggttatgtggggtaagatggtgatgggcagagaggtgggacacgaactagaaagtagcacactttggtagtacctaccctaaatgtgcttcctcattagagggcttagaacaaacacactcgctgctaggttgcggctctatgggaagcagcaagaaaatgtctgatctagtttaaagccttggaggtgggctgccctatgttcttcctttggatgcattaaatattgagacctcctaccttacaaagccagcaagaactcactgcacaactggactcgattttccagtggatctgtaatgagcaccagactttcaaacagtccttgtggagtacttaaggtgggggaatgaacgacagggcatggtgcgtggtggtgcacaggtctggggggccagaaagtgaggtggtgtgctggagttggggcagttcgacgttagaagagactgtcacacctttgtggcagcaggctaaaggctcatggctgctctctgagggatgatactagagaacagcgagtggcattgttctttcttcaactaccctagaagcacaagaaatggctgtgctctagagaatgttttcttgacacaaagtctcagtatgtagttctgctggacccaaattcgttatatatatcagattgtccccaactcacagagatccactagcctgcttctggcctcccctagtactgtcattaaaggagtgcactaccacactgtcctttggttgctattttgtgcagccatttctgtgcttttccttatattgggccaggtagtggactgccttatttataaagatagaagacctcactttggagcacgactctctttttcagagaccctgtacagtcctcatttagatttcccagcagtaattatggagcccagaagataggcttagggtcatctgggagaggagtaggggaggttagtatgggggaggttgggagtctaggaagagagaaaatctgatctttgtagtatcataatgttccatccacattggaacacttagaaaatactggctcctagattctctatcatctaggatggatacacaaaacaaatatctgtgatctagttaatgttagggaggagagggactggatcttcgttgggtccggtactagcttggctatcctcccaaacctacaacacagaccactcttctccaagtgtggcgacggtggtggggaggagcacgtcaagtgtgtgtgaaggggccaggtggggggtataggactagagaatgtcaagcctctaaagtatccgaagactcacattggtcggaggaccctgaaaacactgatgtacactctccctcacctagattggaaaagctaagaaaacaggactttttggtcattgttgttggggtgtggagatttgcatctatagtccttcttccactagatcaagtactgggcatctcttctttataaagatcttaaaaccttattggggatattgattgtcttcctaaaacaaacagaactaaaccaaacagaatgaagccaaggcacctaagctaaccttgacttaccttaccatttgattttgaagtagtgcttgagaaacacgaagtgggactagggtgcagtagagggagataggagggtggagctgggggagggggagggtagcacaggggttctagtggggtaagaatagaaaaagtcacatctctgtcacatcctgaaggttcgttgtggttggagagcctagaaaatactggtgtctaagttctctttcagttaggttggaactgtgaagaaaatgtctgggacccagttaatattgaggggttgaattgtccctatgttctcccaatcactgggttttataacagacttctttatgccttctacgggtgccaagacctcacttctgaccctggctttcctttccagggacaggcccagaccgttagatttcctagcactactcatgcagcatataaggtgggctgtgaattgggctggaggtggggatgtggatcaagagggtgcaggtagggatgtatgatgagagaatgacagccttctgtagtaccctaaaggcccagtgaatattctgtcacatcaccactgaaaattgaaaactatgctggtgcctagtctccccccagctaggatgaaaagctaagaaaatgtctgtgatctagttcatggctgtctgtatatgcatacatatacgttggtggggagagatctacctgttccttgctcttcctttcactgggctatggaggtgacccatagtgcctccagttctggtattggtcttcttaagttgaaacagttaccgagatcttactgaagaggttggctcttcctcccaactgactgtacagacctttagatctcccagttgtacttgccaagcccagaaggtttgtccccttggccttctggtatacagaatttgctctttctgacagttaaaaagcaagcaagcaagcatactgagctcgcttacattaacggcttgctccccacaggcatttctttcttttttggggagagggggtgtttccagacagggtttctctgtattagccctggctgtcctggaactcactttgtagaccaggctgtcctggaactcagaaacctgcctgcctctgcctcctgagtgctgggattaaaagtgtgcgccaccatgtccggcccccacaggcatttctgcagtctgttcctaggcagccatttctgcagtccttctgggttctagtttgctttctattgataagcggcttaagaataattttagggtttctagtgtgataaaacagtatgggtggggctggagagattgctcagtggttaagagcactgactgctcttcggaaggtcctgagttcaaatcccagcaaccacatggtggctcaaaaccatctgtaatgagatctgatgccctcttctggagtgtctaaagacagctacagtgtacttacatataataatagtagtaataatgataataggagttaaaaaaaacagtatgggtaacagtgacttgggggagaaatttcatttcagcttacaattctcaagttactctcagggagggaagtcagagtaagactcaaggcaaaaatctggaggcaggaactgaagcagaagccttggaggttgcttactggttgactcccttggtttgctcagcctgctttctgatggaacccaggagcacctggccagggagtcaaggcctactataggatgggccatcttatagcaaaatgggggtggggagtcctacagacttgcctacaggcaatctaatggaggaatttggtcaggtgaggatggctttagcctgttttttttttttttttttttttttttttttggttttttggtttttcgagacagggtttctctgtatagccctggctgtcctggaactcactctgtagaccaggctggcctcgaactcagaaattcacctgcctctgcctcccgagtgctgggattaaaggcatgcgccaccacgcccggctggctttagcctgttaagttaaaaactaaaacacaggagataagggtttttatttcatccctctaagtactttcaaacttccctctgaaacctcacaaaccaggccttcatcgcctgcatttctctcagcctccctacctcccaaggtcttaatggagtggtccattaagcagtgaccactcaacagcttttctagcccaacattccacactctatcacaaccctttccaaaatgcgggcaactctgtcacagcaacgaccatactggtacaagtttctattctagtttgctttctcttgctgtggtaaaatactgaccaaaaccaacttggggaggaaagggtttcttttaccttactgggtatagtccatcatgaagggcagccagggcagaatcttaaggctggagggagcctggatgcaggaagtaaagcagagaccacagagaaatgctgcttactggcttgcctaacttgcttttttgtacaatccagaaccccttgcccagaggtgatatagctcaggggacctcctacctgtcctagaggagcaagcaccatccacaatgaactaggtcctcccacatcaattattaaataagaaaatgccccagagattggcctacaggccaatctgatgggggaattttctcaaccgaggttcccttttcttagatgaccctgctgtgtgtcgggttggctagaaactgcccagtacatgccctccctttagtctttcttgagagctgagtgccttgccccaacatggcctctcactgctgctgctcctcaggaagaaagcttcctgcccccatttccctttagtctcttgttttttatgtttctgtctttgttgaaacagggtttcactatgtagcccttgctggtcaggaacctgctatgtagattaggctggcttcagactcaaagagatccacttcctgcttctgcctcctaaatgcatggattaaagatgtgcaccactatacctggccaaggttcttgtggggaaacacaatgggcacttaccttaatccaggacagtggcaggtgtgaagtggattacggtaccattactgtcttggggtcttgattgtgttcattctccaccaattaaagaattaaaaggcaggaagaagaactcaggcacactagacaacaatatttaacacactttattaaatatatgtgaagaagggcaccatacacacactcacacacacatatgagagagacagacagaggaggtggtggtggagggaggcacacatgaagaaaagaatccctgcagggccgagaagggatttggaaagccaaattcagtttttaaaatctggggctgggaagccgggtgtggtggcacacgcctttgatcccagcacttgggagacagaggcaggcggatttctgagttcgaggcctatttttttgccatctttattactgatctatgtggcctctttgcctatctatctgcctgtcagggaactacccaatttttagtccctaagcactgaccaagccttttagagcccaaagaccacacaacaattgagtttcaaatgcaaaacctttgcctacaggatttagatctatactgctagattttggtttggtttgattgttttgttttgtttctttttttttttttaagatttatttattatatgtaagtacactgtagctgttttcagacacaccagaagagggcaccagatctcattgcggatggttgtgaaccaccatgtggttgctgggatttgaactcaggaccttcggaagagcagtcagtgttcttaactgctgagccatctttccagcccttgttttcttaaaatttatttgttttatgcatattggtgttctgtctgcatgtaagtctatgtgagggtgtcagatcccctggaactggaattacagacagttgtgagctgctacgtgggttctgggaattgaacccaggtcctttggaagaacagccagtgttcttgaccactgagcagtctctctagcccctttgctttcttttttttttttctttttctttcctttttgttttttaaagacagggtttctctgtgtagtactagctgtcctgaaactcgctttatagacctggctggccttgaattcatagatcctcctgcctctgcctcctgagtggtagtgtagattggtttcctatctggaatgagtagaagcttgttcatatctctccaggaatagtgcacacaacacaatctagtttttaaaatatatataaatcctggctgtttaaaatgcctgttttcaccagttgtgatggcacataccttcaatctctacactcaggaggcagaggcagggggatttccatgagttgaaggacagttttgtctacagtgggagttgcaggccagccagggatacagagtgaggccctgtcttggaaaataaaataaatgaataaatttaattaaaaaaatagatgcctaatttcctcatctgttgcctttattttgttaggctagacagtattcttgattattttggttttaggcatattatttttatcatatatctcatgttaagtgcagagaattaaaaagcagtcacactgggatcttaatggctagcagagtttgacattatccagaaacattaacattaaccttccttaatggctttctcaactagtcctctctctcccaaagtttaccttcctcacatctcagcctcatatatgagtcttttttttttttttttttttttcgagacagggtatctctgtatagccctggctgtcctggaactcactttgtagaccaggttgcctcgaactcagaaatctgcctgcctctgcctcctgagtgctgggattaaaggcgtgcaccaccattgcccggctatgagagtctttataacaatgatatattaatatttgccccacacatgcacaacatgtgatgctagacctataggaggaactatgaatggaagttactagaaactgcaccttccatagaaacttcttcaaggctgattaactgattagaatttcaaagattatggagaagttggaatactgttggtccatagcttaatttagttatcttaaactctatttagcctccttaaaaaagcttttctttagaaatcagattcattcattttattttatgtggtttttttgttgtttgtttgtttttgtttttttcttgagacagggtctctctgtgtagccctggctgtcctggaactcacttcgtagaccaggctggcctcgaactcagaaattcgcctgcctctgcctcccaagtgctgggattaaaggtgtgcgccaccacgcctggctattttatgtgttttgccttcatttatgtctgtgtaccatatgattgcttggtgcttgaggaggtcataagaaaacatcagatcccctggaactggctatgagccacctggtgggtgatgggaatggaaccgggctcctctgaaagtcagggctcttaaatactaagccagctcttcagcctgatattagcttccttaatagttatttcttacccatctcagttcctgatccattatcctgtgactatcagagaaaaaccatttggaatgtattaatttaacaaatcctcaatttccatgacccaaaacattaaataacatttgagacttatagctgagatttttccacttgcctgtaacctgttatctccataatgtgtttaaaaagtgtgttggtttgtgactttcttcttcctgagctgcaatcacttctacttggcttcagaataagctctgtcttaccctctttgaggtaagagtggtatttttgtgtcaacaattataacagcacaaatagacggacacaaatgggctaagggattctgatactacttcattcactacagatattgttattctaggtttgaactctgcccctttctaggcatcacttagttttcttacctagcacatcagggtattggggaaaaaaaatcagttaacctgtacaccagaattacctggccaaggtaggaaagcggggagggctaaaaacagatgcccgattactacatcatagagattctgtttggggataggtcctaaataccaaagtttattactttccccaactagatctcacaagttcaactgtatgggagtctatcagttggccctttggtgaaggcagttttaaagataaacaagtcattttcatgaagattgacaaaagaagctttggggacagattagagactaaaagaaatggtggaagtggctagggtatagcttagttggtagagtgcttgctcatttcagcccactcttacatttcataacctgggaaactaagcttacataaatcaactttgccaatactgactttgatagaatacaactgtagcaattccaactagagtggaggtaggaggatcagaattccagctatatagtgagttcaaggccagcctgggatctatgagacttgggaccagggtggaagacagccagagtccacaggcctaccctttggggactggggtaaacactactacagtgagcaagtatgtggtgaaaagatggcagagaaggagaagcagagcagtttgtgttctatgaagagaggtagaactatgaggaacagcctgatgtgagaggcttgcacagccaccatgatgatgtttgggactgtgctgccgccaaaggccatgtatgcttctgtggccctatagcagcaggcatcagtgtcaatgaccatggcccatgttaccactaaaggccacatgggagtgcacggtctcacacgccatcagaggaaatgttgctgtttgagggcagtacccagccgccgcctcgccccgccccaccccccttgcacgctgaggcacctgggagagctggccccgccccagtgtggggcagtgcaggagggctggccccgccccttgcctggccttaattgcgtgagcgggaaagctggcccctccccttgctcgctgaggaacctgggagagctggccccacccttgctcattgaggcactttggagaaggaggccccgccccttgccatggccatgagggctagtgggctgaccaactcagctaccactcaggcccagatccaaggctttaggttagcccaccccaacacataacctatctatgatctgctgaagtgcgtgcagggggtctgtctgcagaaccaaaactgcagagtctttgtgacacagggcaacagtaggatatcctagagaagtctctgtgagggtctggttttgatgatgtagcagaagtcagaggcctcgaaccagaccaatgactcattgcaataaacatttgcaagttaacatgtgtggagaagggttggagagatggctcagcggttaagagcactgactactcttccataggtcatgatttcaaatcccagcaaccacatggctcacaaccatctgtaatgagatctgatgccctcttcaggggtgtctgaagacagctacagtgtatttatatataaataaataaatcttaagaaaaaaaagatgtgtggacaaaagggtatagtgtgagacacactgtgacacactgcagattccacagcaaggtttttttttttttttaattttaaaaatatttttagggggctggagagatggctcagtggttaagagcacttgactgttcttatgaaggtcctgagttcaaatacacatggtgacttacaaccatctataatgggatctcacaccctctactggtgtgtctaaagacagctatagtgtacttagatataaataataaataaatctttaaaaatacttttagtttttttggggggaggggaggttgctagagtggagggttgatatgcagggatggtaagattagtgggattggagtgcaggatgtgaaattcacaaagaatcaaaaatggaaaaagcaggaagagggaggataaataacagggtatttttttttctttttactggttctccattttacttcctgttattcatcaagtggctcacaactttctttaccttcacaaaagctcccaatttgcaattcactttctatgtatcaccttctcccccacctccccctttgagatgagagtccaactcttgctgttctggaacgtgctgcgtataccaggctacccggaaactcacagagatttgagtttatgcctacttagtgctgggattaaagtcctgtatcatcatacccccttttaaaaaaagaaacatgtattctacttcgtatctttgtggtttagcaaccttgtataatgctagatctcaaaggcttgaaaatcaagagtagaccaggctagagataagcagcagtcagctcacctaatgatacaacatgcattttgtcatttctcatctcgggccttttgctgatcctttgcagtcctttcaagatccaggttctgtattaggaactgaaacatacccaagatctctttctactcattggtaagtcagctttgaatacacatgctatagtttcccaatttcttcttttccccgtgggggggggggtctcttgcttctatgtatttctttggctggaaaatgatagcaaatcgagtgttaccttactggatctcaatttcagtcgtgtcaatattagagcccaaaaagtctgaaacaagacagatttctttgcaaagacgttggacaagtggacacaggcaaagaagagcacagcagctaactgatcagttcaaggcccgttgataggtatttaaagtattagtggtagcaggaagaggggctctgaatcccctaactaaggaggtattgacagtggatagcagctgttggcagagggaaattcaactttaagagtgtggcccttggtagttgcagtgaacgggcaggcccacacccaggtaaatttggacagcacaaactggacttgtggtttgtctgtctgtctatctatctatctatctatctatctatctatctatctatctatctatctattaaaaagaggactcaatgttgagaaggaatgaagtggttagggattggtctgggaggagttgatagaggagtagggagtagtatgagcaaaaaacactatataaaattttcaaataattgatgaaagcatattaaaagattagtggtcatttactttatactaaaagattagtggtcctttaatttgtttttagcattggataagtgatttacctaagcttcagtctggctggagagatggcttagtgcttaagaacccttgccactcttccaaaggactggagttgtgctcccagtacccatgttgaacagctcacaactacctgaaactctagctctagagggtcgatgtcctcttctgacctctgtgggcattggactcttgcgaacatgttcatatgcacacacacaaacactcataaataaaaaataaatcttaaaaaaaattagtgggggctggtgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataaataaataaatctaaaaaaaaaaattagtggacatttagttttttttccccattggacaagttggtttacccaagccttagcaaccctggttctaaattttaccccagctcaaatgctctaagtactgtgctaagcacgtggctactttgtgactgtcagagctttggagtccagaaagtggggaggatagagagtggacagcttagagaatgaagtaagctttaagacaaagcagttaggaagctcattttccctctcaagaaggagttccttatcttcaagttagacatcagtaagcctactttactgaaaaagctcaagcttttggacagtgagaatttttgagagaaaccagaaagctgcggaaatgttaaaagccctataggtatgtaaaatgtgattgggctgaggtctaaggaactgaaaggcaaggggctgcgggcagtggtgacgcacgcctttaatcccagcacaggcaggcggatttctgagtttgaggccagcctggtctacagagtgagttccaggacagccagggctacacagagaaaccctgtcttgaaaaaaaaaaaaaacccataacaaaacaaaccaaaccaaaccaaccaaacaaacaaaaaacaaatgcatttcctcagtacgttgtgtacctacctcttaaaaattataaataaaatatcttggcagggtagcttttgtgaatacaaggactcttgtcacatgccatatctgggagccctgctcctgtttgatttgagaagtctaaatttaacctattcttttttttttttttttttttggtttttggagacggggtttctctgtgtagccctggctgtcctggcactcactttgtagaccaggctggcctcgaactcagaaatccgcctgcctctgcctccagagtgctgggattaaaggcgtgcgccaccacgcctggcttaacctattcttaatccaactgctgacatcatagcttgattaaaacctactatgctatcttaagtgctatgataatacagacaggaatttaaaacatgatttttttttcttctcatgataccataatattttagttgtggtggtaaaagaggagtgctttctcctttctgaataaaaagttgagatttgtggactgacaaatgtaccttttctggagacacttgaatagcatccccaacgtgtactataatttttaaaaaatctggataataggaaacacatttgcagaaatagcatatactgtacacaagtgctaactaggtaacaaacgaggggacaatgttactagatctttttttttaagatttatttattatatgtaagtacactgtagctgtcttcaggcactccagaagagggcatcagatttcgttacagatggttgtgagccaccatgtggttgctgggatttgaactcagaacctttgaaagagcagtcggtgctcttaatcgctgagccatttaacatggggaaccagcccaggagaaagcagtttgttgcagtcaacaaagctgaaaaaggagtggagatctgaagactgctttgacatcagccatggagatgcagagtttggagtttgcccagctggtttcctgccttgctttggggatcacagttaattaagttgaatgaatctcagaagagaccttgaactttggactttttaacattgttgcaactgctatagactatgaggactttgaaagttggactaaatacattttgcattatgctatgtttaaatatggccccatgttactagatatttctacttacaagggccacaccaattcatggacgcaagactgccagatcctcttagagaacattctactaaggacacaaatacttcatttttcaacctagttcctgagttcccagagcatcctctctatgttcatagagctctatctgcctgcacagatttgcacaccatgtgactaagatgcagggtatcatcaaggggaagcaagaagacctttctgattccattaatggtgggtgcttcaggttaacgcatgagctttgcatctagggcacttaaagaactggtaaagatgcacaatgttgccttacaatgttaaataatgtgagcttaaaaatggagacctgggaagaccattaaaaaatagtgaaactgttcacttgacagtgtagaagtggaaattcacactgcctaatacctcacagttagtaaacagaaaaacaaggcatttggatacaggataaattttgggttgaaagttttgtggatgggttatcctgtatccaaatgcaggtacaggggatggagaagagactgaggaaatgaccaatgaatatcagcccaacttgagacccatccctgacactattaatactctgttatgcttgcagacaggaagctagcatgattgtcctctgagaggctccacccagaagctgagtcaaatgaatgtagacactcacagctaaacagtggatggagcttggggactcttatggaagaataggaggaggaactgtgggtcccagaggggataggaactccattgatagaccaacagagtcaactaacctggacccaaaccatacacaggctggacctaggcctccttttcatatgtagcagatgtgcacctcagttgtcatgtgggtcctgaacaactggggcaggagctatcccaaaagctgttgcctgtctgtgggatatgttcttttagctgggctgccttgtcaggcctcagtgggagaggaagcacctagtgtcacagagacttgatatgcccagggaagtggaaggagatacccaggaggggccccaccctctcagaggagaaggggagagggagatgggggaagaattgtgggagggggttaccaggaagggggctgtgagtgggatgtaaagtgagtaaaaaaaatgtataacatgaataaaagagcttgctttaattaatttggctctgatgatctgagtcggtggcctttctcctcccacatttgggattaacagtaagattaaataaacccttaaatcaatcccagttttggtctgattccttctttcccggttttccctttttgcaacaggaatgctttgtgtcattgtgctttggcagtatgtaacttgtttttgatgttttaactgcttaggtagagctgtgtttttaggaggctttggactggacttttgagcaatactgaaacagttaagactttagggatttttttttttttttttttggttttttgagacagggtttctctgtatagccctggctgtcctgggactcactttgtagaccaggctggcctcgaactcagaaatttgcctgcctctgcctccggagtgttgggattttaaaggcgtgcgccaccaccgcccggcgaatttagggatttttacggactgaaagcatcttgctttattgttacccagcacccagactcataaaatggctgccactgaccaggtatagtggcatggtgcatgcctgcgatccaggcaagttgggaatgttaaggcagaacactgcctgtgagtttggggctaacctggtgggtttcaggctaccttgtgtgtgactgtggtctggccacctttaaaagaagtaacaacaaaacaaagagcagagaacacccaaaaccaaaaagtaaaaaataaaataaaataattccttaaaacaaccccctcccccaaaaaaccttaggctgttactttttctgtatttttaaaagaattgagaatggaaattggtaaaggaaaatgagtttacttataatttggacaaggcagggaaagaaagattcattgtctcttccttgtcatgcggaaattcagggttctcagtatggactcagtcttgttaacaaaagaatctaacaaaagaatcacaggtagacacggtggtgcatgccttgaatggagcacttgggagccagaggtaggtaggtgtatctccgaggccagcctggtctacatagggagtttcaggccatgcaaggatatatatatttattgtaagtcagtgttccctccacctcttccccccaaaaggacagaccaaaaaaaaaaaattcaaacaataacaaacaataaaactcccacagcctagcctcaagaaaaaaacagataggcatacagaggatgcaagctgtcaatctcagcagttgccaggaggagggagagaaaagagaaagaggaagccctgctttttgagttaggatccaaggtggcatgttcagtaataatgcaggttgacaagaatttgtaggatggtctccaggcccacctggattaattattattattatttaaaaaattattgacttcctgtgtatggatgtatgagtgcctgtgtaaatttatgtgcaccccagacccatagtgctcttggagaccagagagtactggatcccctggaccttgagttacaggaggtgggagccacttgatgtgggagctgggaactgaatatgagtcttctgcaggagcaataagccctcaaccactgaaccatccctccagccatgggctaactgttgagggtggagacgctagtatgctctttttctaatctttggagtgatcagaatgtcagtttccacctagagccagaggcagagctcagaatccattctttccaccgggaggaagtttagctttcacttaaaggaactctccacccgggcaagagaactttaagttgtaaattggacggggcaggcaatgggagtacaggtgaatagaggaccacgccagaaaggtccatccacaaggctactaaccctatctacctaacaacagcattaaacttggaagaggtgaacagaaagcagcagatacacatatggtaacctgagcatgaggtaagctgttagaatagtgggaaatctcttcttccaccagcatggggttactgggcaagtttgaattggtggggctccattattttagggctcctattttactgtgagatggacataaacccttggaagtcatccacaccaattttttctagacttttccaatacatttgtttctattgtgttctatgtgttttctctgttttcattttgttttttgagacagggtttctccatgtagccctggctgtcctggaactcactttgtagaccaggctggcctcaaactcagagatcctcctggttccacctcctgagtgctgggattaaaggtgtgctacactactgctcagcttttcaacttgctcttttcaaagaaccactgtcattgtcaacaacttccactgacagaactaggcttatttttatgtgctctgtgtatgtgtatttttgagagttcatgtgtgcctatggaggctggaaagctgagctctgaactgctgagccatccttctaacccttattttgctattttcgatgaattttgcaaaggcattttttaaaaaatctagtataactggattaatcacctgaatacaacttaagtagaagatgctgataaggagtaacttgctggtaagacgcaggacttgctaagcactttcatatttctacactctacgcttaaacatttatgtttagtaagatcattcaaaaacagctttctacttagccatatgtcaaacactgggtacaatgaaggttcccaaagccaataaatggcatgaattactacttatacaatcagacacaatactactcaatgggaggagaggcaatatgcaaagtgttgtcattaaaaggaagcttcaagtaatagtgatctctacaaagtgatttatcattgttatcagtagtttcagccctgattattagccccagctggcctggaacttgctatgtagaccatgctgactttgaatttactataatcttcctgcttcaggctctggagtgctgggattagaggtctgtgccactacacctggcttgttgagttatggtgttcgattgctaccaaagggggttgagaatacgtttgatgatcaccatcatagcaacgttttcataaggcctaaacttgtgtaaaaattaatataaattaactttattatacaacatgacaaattgtgatctggaagtgtaaaccaaataaactctcctttcctttttaatcccagctctcaggaggcagaggcaggcagatctcttagttagagaccagcctggtctacagagtgagttcaaggacagtcagggctacacagagaaaccttgtctcagaaaaaattacatttaggtatttatttgtgtgtgtgtgtgtgtgtgtgtgtgtgtgtgtgtgtgtgtgtgttatatgaggtcagaggacaacttgtagaagttagatttctccttctaacatgtgggtcctggggatcaaactcaggtcacctaggcaacaagacttttaccatctgagttactgtatctgcccctaagtaatgatattataatgatgaaaacctaaggaaactgagacggtgtgccccaaagccacacggttcaactcagtaccatgggtttgtactttattggaatttgcatcctgagaataaaattgtatctgacaagtgaacaacgacagaagcagcagtgggagtttcagaggcaggtagccttcttttggcacagctgtatataggttgagttcttccaggagagtcagtcctggactccagggggaagaggaattcattccacaggctacataacactacaagatgcatgaatgttcttggttcgacagacatagccactatgattctcttctgggaaagctgttccaacaggaatccttggccaaaatggagaagttgtttcatttttcaatccaatctttagaacaacgccagctctatctggatgtccttgcagtagaaattcacacttatatataattagtccaaggacagcaaactagcttgtagattatataatttcaaacatttgtaacttgttccaaagtcctggcattagaacaattttcaactatttgcttacaataaaaacagaaaagcaggaaaactatgccaagataaaagcaaatcaaagaagcaggagtaaaaggaccatttgagaacttattgccttgattaccatacaggctttacacatagaactactttcagatgctgagaaactgttacttagactaatgctagaacatgacaccagaacactgcaatcctgtacatttgcaatcctgtgtgtgtgtgtgcatggacacaccccactgaatcagttcagttctagagtccagagacaaaccaaaactgaaggcaaattataatctgaatttatagcttaatctagtcaattctcatttattttctctctctctctctctctctctctctctctcccccttgcccccaatcattcaggactaggacacaatgtgttgagaggccaaataattttagttcttcttaaaagtggctcctaacattttcattatatggatctctaaattccttccccattttcaagtatatattaaagtacacttaaggacagctttctcatttctattaattacaagcacacttccattcacagcttttaatcagtgtcagtaagcatgtcaatagacagaacaggaaagaacatgagcaaaatgcatggtgattccatgtgttgtttggctggtgtagaaggaatgtgataggtcagtgtgtggcctttagtgttatgtgaattaatgattcttgagaaaggctcaaggctactttccactgctatttttcatctactctaacctgagggccactagtttacacccacctgctttcctccctaaatcaagtattaatatagtacaatcactcatgtttaacaaatagggcattagcaacaaaaatgacttgggaaaaaaattgagtcagaacactctgtaggatgttactgagaaagaaaacataatgcagactgaaagtcacatctacgtagaaattatataatcatgctatccaatatttcttttagtcagcttctaagcacacagacacatgaaaaagaccctcaattcccctgtgaggtaggtccagaatattgtccccacttcagcaatgaggacatgaggtacagaggaattaagcagcagagctaggaatgaaaccagaagtgacttgggtttgaactttcatgccattttcctttccaccgaattttctaagtccgttcggatagatccttttggtgagcagggaacttggtgagacactgaaggagatgtgaaattgagcctgcaactcttcacacagtctaagcggataccaatgtcacacctgataccaactgcgtagtcagattccacatggcaaacagagatcccagcccctccttcctagggaaactacattcacttttatcagcacagagggaataaggtctaccaggcattgggttctttgagtgtgttttcactaacacacatcaactagcagccagccagcaaactgaactcaaactgtgtgcaaggcactgtgagtttccaccaagtgcagatccgagaataaccattttcacacactgcacagcaaagatcttctgtggcttctcagaaccacagaatggtaactaacctctcatttcctgtctagctcaaggttcaaccctctacttttacagaggaaaacactgacacataatttagaccacttgcctggggccacaatattagatagtttcttcattaagtctgactttgacaaaattcacagaaaatggaacatattctcaggttgccatcatcaaaataaaaaggctggctcagaatcaggtgagtggaaaagctggagcaagataagaattatacacatacatacatacatatatacacacacacacatatatatacatacacactcacacatggaaggatatacttatagatacccttctattatttttagctcacaaagtatatgaacaagtattaataaacttattctttaccacgaaaaatttcccaacagttcaccactcaagggaacctgaatgatttgatagttgtaaaatagacctttttttttttaaagaagcagacttaagtccaattataagtataattggacttaatttcaatgaattgaatacttccagtcaatttaggaaaaagtatttccactatgtgaagttagtccaatgaatcagatgagtgtaaattctgtatttgcttaggacatacagtaaactcaaataaaatattgtttggggtctttgtgttcaagtaatggtttatttttaagtggcagcttatctgtaagcaaaaatgaaggtgctaaggatttgtaaaggtctcaccacatttgaaaatacctaattgttgttaggcttacaaatggtattgagctctcctaaagttatcaaaggcaacaataattctcattaaaaatggcaatgctgggcacaaatacagtttaatttctgagatattaatgtttacaggtcatgttaatataaaaaatggggaattattattattattattattattattttggtttttcgagacagggtttctctgtgtagccctggctgtcctggaactcactgtgtagaccaggctggcctcaaactcagagatctgcctgcctttgcctcccaagtgctgggattaaaggcttgcgccaccactgcctggcttgggatatttaattcttaagtgagttttggtagggtcttcaatcaaagacagtccttccagaactgtgttaaattctatgcttattagcattaaaatcataccaatttttaagtgcctggtctattctgtgatattttgtcattaatatacaacattattagaagataagtaaatggatttaaataagagaaatataataacctagtgctatcatgcctacttgaaaagaagcatttctaatcattattaattcatttattctgcttccttctacataccacgttatctttgaaaaagacaaggcactttcccatctatttctaaagttacaataatctttttcctaaattaacatggggtaatgtgggaaacaagtagaggacatgtctgagacaagggcaagtgacatttgcccttatttttattaataatatagatgctactggccttttacataagctttaaattgaccaattggatcaatttattaaaccataatcttggatcaaatgagaagtaacaaaaactaacttcctttcctttcctttcctttcctttcctttcctttcctttcctttcctttcctttcctttcctttcctttccttttttcttgagacagcttgtagcccaggctggcttcaaattcacagcaattctcttgccttagccccataaatgctgggattcactaatttatggggtataaaccaccatgccaggcttttcagaataagaaaaaaaaaaaaagtcctttaagttgaaatctcaaagcctatagagatttagaagctttggcaaaatgttatttcaaaactttttttcctttggaaactaccatggtaataaaggagtattatatatcaacaaaattattctcttttttagtcaaaaataactttcacaaaatacttggctaacccaatagaaaaatacaagttacattctatcctgaggttaaaagaaaagaagtttggaggggaagggttagcatttgctgtgactaatttcaatgaaaaggaacttcttccccactcaaactaccagtcacataaaaaagaaaagtaacgagaaaactatcacctgtcaatcaatatactgaacaataaaataatacagttattagtgaggagttcaaattgatatgacatgtaatgataaatattttaaatgacaaatactattgtaacttgaatgatacttggtcactttcatatacaatctattcctgtcttaatatttgtttcatggaaacaattcattacacttcttgattttttttttctgaacaaaatgaagtgtgatttgtacatggcagaaaaaaattcctatgatgactatttggtcaaattctaaggctacagacgaaatgtaagattgctgaggattgacattcacaagtaatttttttaccagtgagaattaaaaattctatattatgatggaaatcaattttggtattaaaacaccacagtatgaagcataaatctgatgacattagctgaaacataagacatagatatgtttttccctgaccttagctataaaacaagacattgggtatgcattttcaaaggcttccttcttatctataaaaatacaccttcaattttgcagcaggcagacatatttgcaggcatacataatatattagaacttagagatctggggtggctgggtggctcaaaaagattttgtgcaaaccattagagccacatatcaaacaggatgtccttcctctttccaccaaggactaaggatttcagattaggcataactcttaaaagtgccttaaaaaggcttgaccttgttaagcttgttccgttcactgagatgagcttacttaaaagcagttaagaatagaaggacaaagagaatagaatgtatgtcagtcactgcaaattacaaacaatgcccatatacaggcattcacttgcagttgaattaatgtgatagaaaaacatttattatattatattataatttcaaattatagtagaatcaaagtagtaacatcactcaatttaattatggaaaaaaccagagaaatatgcatgtatcaatcaaaaaatgtggccaatttacaaacgaaaacaattttatctaaattttacttgtctttcctcaataatttataagtgtttaaaaaagatccccaatcagacggctgaaactgttttctcaactctgactagcctactatgtaggtagagcttctctgtgctctttctcaatgtaggatacaggaacttcagaagaggataagccatggctttcacggaggccttgatacctcacataagaggcaaaaatctcaagacactttgttttttttttaagacagggtttccctgtgtagccctggctgtctcagaattcatactgtagaccaggctgtcctggaactcatactgtagaccaggttggtcttgaactcaaagagatctgtggcctctctctgtcttctgagtgctgggattgattaacggtatgtgcccagctcttaagacatttaaagactgaaatcttgtgtaccttcaaagaagggaaaggaaatgagagctagtgaggctgtaagatgggggtggagtggaggagaaatggaaaacagtgaagtaaatggaaaagaaggttcttggtctcaggtgtgatgcctaagatctgaagtaatgatttcaattttaatccacttattaggaagggcactccgccccacacctgaaatttaacatactcagtttggctttgccacaaaacagcatgttaaaggtctctacattcaacaggatgcttacaaacatcattcatagtaaaatctatgtggaattgttggcaatacattgataataataatacattctgtaaaccatggcataccacattttacattatgcaaagagacaatatttacaagtctttaggagtttaaatattttatccactaacataagtgacaatttagcaaagtgcaggaggaaaccagtgctattaattgcattttctttaagagcagagtaaaaccatttctaaaagctaccaaaagcttatttgggtgtgtccagtaagggattacagagcattaaatagcctagaaaaatgatgcatatttagaaacagtgagtatgaaaatcataaggcagcatgctcagaacaaggtttttgttttgtttctttaaacaccagcactgatgtttttagtgttaacgataaatacgggtatatgtttgcatttatttaaaaattgagagtgcaaaacacaagcctcatttaataacaaaaaagatgtgcaaattttcttaaattaacacaaataaaagagtgagaagaatagtctactgttgtaaagaataaattgaacacagcgaaggagactgtctccattccaagatcatctacaaggcactaagggtaggaaatgacagataacacagaagagactgaagaaaactcctcagtcgggtcggaatatggggtattttggtaagaattctattagtattacctgtaaaataaagacagaaaagaatatattgacaagatatttttcatttaatgtacataacccacaaaatcttgttgagtaccacaggactgcattttcatcgtggattacagggagtgattgaaatgcaaaaaacagttattcaaagaattaggttatgaccaaacaggcctcttgtttccaaatcaaactggcagccaaccctacccactagaactaacagttgttattgcctgatttatgacagacatttgccaagaggcaaaccctattacagttttatatcccgtaccttttctttcagccaagaagaagaggttaaaactactttatatagattagaaaaaaatatttctgtttttgtgagacagggtctcaggtctcactatatagccctggctggcctggaacttgctatgtagatcaagctggccccacacttacccattcacctggcctctgtttctaagagctggatgaaaggtgcaagccacttctattattatgttcttctattattgttatgatgaaggcaggtctatgtacctcaggcaggccttgaccttgctatgaagtcaaagatgaccttgaacttctggattacaggcttagagtggtgctggggaccaaactgagggttctagatgctggacaagcacttttctgattgtactatgccctcagcccttggaatgtttaaatgataaacactggaagtttggaaggttcaggatgctgaacagatcatattgtttatatgtggttttatgctttgtgactaaggctacctattttctttcatatttgaaaagttttttgaggtggggtttcattatttagccctggctggcctgaaactcgcagggatgtgctcacccctgcttctcaagtgctgggataagaggtatgtaccaccgcacctagcaggatttagcctgtatcaaatctattttgatagattttactcattcaatagtttattcactccaagctaaatgccagccaaattaaaaaaaaaaaaaaaaaaaaagcaaaaagcagccagggatgtgagtccaaaactgagagtgaatccctacataagttttttgataagcttgcacctcagtggattttgctaggcagcagctgttcttactgccatatgttatatagtttgtgtctgaggtaacagaaatgaagggtatggaacattttcagctgagcacaggagctcagacttttcaaagatgtaaatgatctccaaactccggagatactttaggttggccacaaagcaaaagaaaatgaacggtggcctctgcaccccaactgacagaaatccgggctgagaagctaaaaggcacaattaacagacagcaagcacaaggcgtaaaaatccaaagaatgcaattaaaacagcttcatacttacatactccatcatattgctagtttcacatttccttttagtcagtttccagtgcagagcaagctaaaaaggtaagagttttggttaagaattcttctatctttggctaattatatttgaatatgtcactaaaagtacaatctaggctgcttgagataaaacagtacctcacaacccttatcaagaagacatactaatgggctggagagatggctcagtggttaagtacactgactgctcttctgaaggtcctgaattcaaatcccagcaaccacatggtggctcacagccatctttaatgggatccaatgtaatgaggtctgtctgactctgaagagagctattagatataataataaataaatcataaaaataaaaactaaaaaaaaaggaaaaaattcttttttttttttttttagatttatttattgattataggtaagtacactgtagctgtcttcagacactccagaagagggagtcagatctctttacggatggttgtgagccaccatgtggttgctgggatttgaactctggaccttcggaagagcagtcgggtgctcttacccactgagccatctcaccagcccggaaaaattctttttaaacaaagaaggcatactagtaactgaggaatagtccattagtcgattcctttgtggacttagtacttactttttcaatttgataatgcaaacatatgaacggagcacttacttgcctacatgtcttaccttgtggtataatctgttattttcccattctagtaacttctgaatcgatcttctggtctaagaaaaaggatcaagattctgtgataagaggagctgaagaacgttataagctacatgtgtctgtgtttttctgttttcttgtaaggtacaattaatttcttctctggtttttctattataaaccagagaaaaggcaatatatttgaaagaaattgtcaaaagcaaaataactctttgggtggttactatataggtagaaaaggagctctacctatccatccatctatccatcaatgaaactttaatttatgcttttccaaatgaaggacgcaaataaacggtatgtggctatgcactggactgctatgaaagttgagccacagtgctaacacacaacagcagcagttgtagacccagtacagttgttcataaacctttctcacaactactttttcaatacagatacagatacaggctgagttcctccaggcaaacccttttaagatgcaagtattttgtagggacttagaaaagtagagcttttaaaaccattctaagattaccaggaattttttattcttattagaaattttaataagtttctgattaaaaataaagaaaagccagatgtagcacacatctgtaaccccacctttagggaggtgaatccctgtgagttctgggccagtcaggagtcacagccacactgtgagatcctgcttcaatataaataaaaaggatggaagacaggaaggaaggactcaattgtaaaacaattaaaaagaaaaatcagtagaaaggtgaaagacctgtatttggttaggcttgtccacgctgtttcaatgcaacagagaaagaatatcctaaagtttgtatggaatcaccccccccacacacacacatatacaccctccacccctaccccaaccccatgacccaaagaaccaaaagaatcttgagaaagaatgaaggtagagatattacatatcctggtatgaaactatacttgaaaggataatcaaaacagtatgacactagtataaaaggcaggtatatggggctggaaagatggctcagcagttaagagcactgactactcttccagagaacctgggttcaatccacatggtggctcacaaccatctgtaatgggatctgatgccctcttctggtgtgtaggaatacaagccaacacagtgcccataatatataaaatactgaaagaaataaaatttgtatatgctaaagaaggatagatgtggtgtcctacacagtattaaaataagacagggcagaagactggggttcagtttttagtacctatattgggacgcttacaaccatttgtaattccttttttgggctccatgagtgctagcacacatgtacacacacacacacacacacacacacacacacacacacacacacacacacagaggcatgcacacaagcactcgtggaaaaataaaaacaaaacaaaagaacaaaagaaaatcaaacccctccacagatatatagacaaatagaacagaacggggagcataaaagtaaacccagccacatactcaactaaatttcaacaagatgagcaaacgtctacagtagggaaagaagggtaggttcttgaatggtgtcaggtagctggatatatgaagagtgaagttggccctagcttacatcatacaaaaattaactcagaatgaattaaaggtttaaatatcagcccacaacccataaaaattcttttaaaaatatcatctatctatctatctatctatctatctatctatctatctatctatctatctatctatctatctgatatgggattaatttccaaaacacataaagaaagcaacaaacgacaaaaacagcaaggaaccagtcctatagtggaggaggaaaaaggtctctaggcctttgccttaagctgctctaggcttttgtttcaggtcaagagggtaaggaaggaaccagccattttggaagtttggcgccttaattatgtagtcctggcccctctccctatctgtctgtctatcagggaatctgtctaattccgggtcctcaatacaatgatatatacatttgtaggacactctgaagccatctttttcatggtcagacagtgtttgctgagaccagcagaatcccggatgtgaggaagtggggggaagggtgagatatgcatttagtagggcaaggtagcacctttaatcccgccactccagcgggaggcagaggcaggaggatctatatagcaagttccaagacagccaagtctacacaatgagaacctatctcaaaataagtaataaagaaatgtgcataaatatctttccaccaggtaaggatggtatacacctttaatcccagaacctgaaggcagaggcaagaatttgaggccagcctggtctacatactgaattccaggacatccagggatacacagaaaaaccctgtttgaaaaaaaaacaaaacaacaaaacccaaaacattttaactttcctcagtgtttggttttgtttgttttgcttgtagtcacttcagttgttctgacacaaggtggtgctctaagtccaggtgtccactacagtctctgcagttctcaacttgtgacttgcgacccccaacactagatagcctgcatattagatatttacattgcaattcccaataatgccgaaattacagttctgaagtagcaacaaaagtaattttatggttggaggtcctatcatttaggaaggtggagaaccgctgatctagagctttataaagcaggagactggtaagggaggaaaatggcatgtttggcaacttgattaactaagggtgagtgcagccctccacggtagctaataaataatgaagccctactaaaaccatatcactcatcaaaccagatttgcatttatacacatgcactgaaaaggacagagggattttgccctctgtgatttttcaggtgctgtctaccatttttgttttgtttttttggtttttttttttttggggtggggggaagacagctgtttttctcactggtcggaaactcaccaagtgggctaggcagctccggtctttaatcccagcacgggagatgcagagggaggtggatctttgggagttcaaggccagcctggtatatagatcaagttccaggacaaggggctacttagtgaggcctttcatgtcttggggaagggagaagagaaaagattaatgaagctaaagctttactaacagagtaagaaaggagcagataaaagttagtaagtacttacaaaagtgatagaggggctagcagttttcatctcatggactagggaaggaatagtcttttttattagatattttcttcatttacatttcaaatgctatcccaaaagtcccctataccccccccccccccactgcccaacccacctactcctgcttcctggcccttgcattccctgtactggggcatataatctttgaaagaccaagggcctctcttcccactgatggccagctagaccatcctctgctacatatgcagctagagacacagctctgggggtactggttagttcacattgttgttccacctatagggttgcagacccctttagctccttgggtactttctctaactcctcttttttggatgtgagtacactgtagctgtacaaatagttgtgagccttcatgtggttgttggaaattgaatttttaggacctctgctcactcagttcctgctagctctggcctaaagatttatttattattatacataagtttactgtagctgatttcagatgcaccagaagagggtatcagatctcattatgggtgattatgagccaccatgtggttgctgggatttgaactcaggaccttcggaagagcagttagtgctcttacctgctaagccatttcgccagtccaggaaaggaatattcttaataactttttttttgcctgtagattgatcattagcatgagatggaataattatttgaaggagacaaaactcattcaaggagaagaagcaatctgaatgagtctatagcaagcaaattaaatcacgggctagagagaagcttagtggctaacattttctactctttttttttttttgtttttttgagacaaggtctcactatgcagccctatataggggaattatttccacagtacttaaatcaaataaagataatatacacaaatatacctgtaggacagtggtggtgcatgcctgtaatcccagcactcaggaggcagaggcaggtggatgtctatgagtttgatgccatcctggtccaagttagccaggactacacagagaaaccctgtttcaaataacaaaacctgtctcaaataacaaaacaaaacaacaacaaaaatcagccaaccaaccaactgggatttgaaaatcaatcagactagcaactttaaagaaaaactgtgcaatcataccaatatattcagggaaggcttttgatacaaagaaacacattcatgatgaaaaaccatgagtgaacccaaagtaggaaggaacttcttcaacttgataaataatatacaaaaagcatacagctaaatttatagctaagatcactcatgtgacagctgagggccatagccaatattcctattaaaaatcacagtgactggcatagctaatgtcatatgacacgaaagaaaagacagaaagaatggggcgtgtatttggttgttcaccgtcatgtaacagtttactatagagcaggtagcttatgaaaagcagattttactcagagttatgctggctagaacagtagtaaaagaaaaataactaaatctgagcgtagagggcaggagagatggctcagcggttaagagcactggctgctcttccagaggtcctgagttcaattcctagcaaccacatggtagctcacgaccatctgtaattggatctggtaccctcttctggtgtatctgaagacagaatactcaaacacatacaaataaataaatattttaaaaagaggggatagttaggcatggtggcacatgcttttaatcccagtatttggaaggcagagataggtaaatttctgtgagttacagaacagcctggtctacaaaatgagacaatatctcaaaaacaaaacaaaaacaaaagcccaaatagcaacccccaaaccaacagcaaaacaaacaacaaaaaactccaaacaaacagggtagagacatgagtagaaacctctacaaagaagatacacaaatggcaaataagcttgtgtgcttgtgtgcatgtgcacatgcacgcgcgtgcacagacacacacacacacacacacacacacacacaaatctgtccaatatcataagactttgtagaactggaaatcaaaccaacagtgaaatactgctgaacatgttttagaatgctcaagatctaaaatattggcaacaccaaatgctggggatgatgacctacacagaaatcctactcacttatgctaggaatgtggaatggtattgacaccgtagcagtttagcaatttccttcaaaacttcctgatcagccactgtgctttttaaagaggttgtgaaacatctggggaagaaggcatggcttgtgggggtgggtcactgaagtaatcctttgaaaggttttagccaggccacacttctgactggagttctctgctttctgattagccatgacttggatgagctacaaattcttgatgccacagacataatagtagcctgtctcgatggactatattcttgaaatcatgaaccaagctaaggcctttgttccctacgttgcatttgtcagatattctaccacagaacgtgaaaagcgaacaagacaatacttcactacaaaaatccgttctggatttgataaggagacatactgctttgctactactgtaataaaacaccatgatgaaggtaacttgaggagcttatttgggtttacagttccagaggattagactctgagatggcataaggaaggtgtggtagcaaggacaggatgctgagggctgacttgagggctaagcatgatacagagaactgggaatgaaagcttgaaggccacctcctgctgacatacttcctttagcaaagcctggtctctaaaacctgtccaaacagtgtcaccacctggggtccaagtattctaacatctggtcttatccggggatattaaaatttcaaaccacactaggaaaaaacaggaatgggagtgggcaatgaaagaatgccagattaaaaaaaaatagcaaagtagaaaaaaacaatcaaatctttccgtcttatgagctgaatctgttctctgaaaaaacaaatccacattgaaatcctgcccctcagtaccttggaaagtaaaagaatggaaggagatagttcagtacaaatgaggtcttacgggtgtactgtgccttgttgttggacaaagggtttcaggctatcatggcacttgctaggtagctgaggttggcatttatgtcctgatcttcctgcctctacctcctcactgctatgatcacaggcatgaggggtatgactggtatttttataggaagagaggattaaaaatcagacatgcagagagagagacttgtgaacatatagaaacaagactgtaaattaactgtccagaaagactcagaagagcaatcctattagagactatttattttgtcgtttttttagcaaaggatagggtcttactcactatgcactcctagtgtggcatttacttctgctgcatgtggatccagatgtagaactctcagctccttctcagcaccatgtctgcctgcacactaccatctttcctgccatgctgataatggacctgtaagccagccccaatgaaatgttttttttttttttttttttaagaggaagtcatggtgtctgttcacagcactagcaaccctaactaagacaggactcctagcttccagaactgtgaggaaatacattttagctggtcaagttacctaatctgtgctacattgttaccaaagcatcaggaaacgaatacattgttattagtcaccttaaaagtcaatagattaaactctcatttaaaatgtagatattttcagactggattaagaccatgacccatctattatattgtacatggcactaaattcagaactagggacacaaatagattgaaaacaaaaggacaagagctggcgaggtggctcagtggttaagagcacttgttactcttgcagaagacctgggttcagttcccagcacccacagggcagctcttaactgtctataactccagttccaggagatccaatgacttcttttaacccctgatagtaccagatatgcatgtggcatacatacaatcaggtaaaatactcatgaacataaaataaaataaacctaaaaaaattaaaaagaaaaggctacaaaaagatatttcatgacatattaagcaaaaagagactctggcagctatgctaattaatataggacacaatagacctataaaataaaaagaataaaaagaaaagaacatttaaatgaaaacgacagactacacacacacacacacaagttaatctgttcaggcagaataacaaaaatggcataccctgttttgtggtttctttttaaataatagccactgagtcagatgtggtggccctagcacttgggaggcagaggcaagtagatatctgtgagcttgaggctggcctggtctacatagcaagttccaggacagccagggctgttaacacaaagacatcctgactcaaaaaccaaaaccaaaaaaaaaaaaaaaaaaaaaaaaaccaaaaaaataaaaccccccaaaacaaaaaacctcaaccaaacaaaaaatgaaaccaaacaaacaaaaagctccagaaatttatgtggcttccaatttagtgttataagacttctgagtgtataaatgagtggagctttgattcttgtgccttcttttgggctgttttatttctgtttgtttgccttgtccaacttcgatgtgatagtttttgtttgttcttattgtattttattttgttatatatatttattatctcttagaagcctgttttttttctaatgagaaacagaaaaaaagtggatctggatatgaatggaggtggggaggagctgtgaaaaggagagggaggggaaccataatcaggatatattatatgagaaaagaacctattatccaggggctggtgagatggctcagtgggtaagagcacccgactgctcttccaaaggtctggagttcaaatcccagcaaccacatggtggctcacaaccatctgtaacaagatctgactccctcttctggagtgtctgaagacagctacagtatacttacatataataaataaataaatctttaaaaaaaaaaaaaagaacctattatccattttcaataaaaggaaaaaaaccccaagagttttatatatatacaaaaacaaggagagacagagatagtgatggaaaggcaaaggaggtagaggatgtgaagagaaaactctctctggccttttcatctaagggcaataatcccataaagacttcatctcttgtaaggttagaggactgcaacataatgaatttggtgaagatatataaacattcagtcactagcaatataagccgattgatgagaggataaatctatgaagaagacataatcattataaacatacatgcaatgatcaagaaactcaaaagtacgtttaaaaatgaactacactaaggtgaaaattaggtaattctatagtaacagagactttgatatactactttcagtaattgataaagcaactatgcagctcaatagagaaacccataaaggaagaaattaaacgccatactctgaagcaatgaacccacaagcaaacggagaatactgaatgaaagccgactattacatggtatatgtacagggcataaactaaagcagtccttggaaggaagcaaaactatgaatgacagtagtaagaaggctgctctcaaatcagtaaactgattcacaccttatggacctagtaaaaagaacaaattaaattaaaggcaaaaaagaaaaacaaataggagccgggcagtggtggtgcacgcctttaatcccagcacttgggaggcagaggcaggtggatttctgagttggaggccagcctggtctcagagtgagttccaggacagccagagaaaccctgtctcaaaaaaacaaaaaccaaaccaaaccaaaccaaaccaaaccaaaaaaacaaacctccgctggagaggtgactcagtgggtaagcgcactgactgctcttccagaggtcctgagttcaaatcccagcaaccacatggtgactcacaaccatctgtaatgagatctgatatcctcttctggtatatatgaagagaacaacagtatactcacatacatataataaataaatattaaaaatccacaacaacaagaccaaaaacaaacaaaaagataaaacaaaaaacccttatgaagtaaagcggttagccagtaaagctgaccagaaaataaatgggggaccgggagcatactcattagtctttaatattacttataaacacaaatatttcttaaatatggctatgaagagatagtggctaggctggatggtggttgctcatgctttgaatcccagcacttgggcaggagaggcagaagagtctctgagtttgaaaccagcctgaattacagagtgaattccaagataactagggttacacaaagaaacccttgaaaaggccagaaagccaaaaaagccaagaagaagaagaggaggaggaagaggaggaagcatgcacccaaagacctggattccattcccagtactgtataaactaggcatagcagcactatagtagtctatataatcctaccattcaggaaatagtggatgcaggactgaagttcaaggccatcttcacctacatagtgaattcaaggacagcctgggatatgaaacatggtctcaacaaacaaacacacatacgcatacacacacacacacacacacacacacacacacacacctcccaaaaggttcaaaggcaggctacatttaagttctaacattgtatggaatagtttcatgtcttcttagcacaagagcacacaatatattttgtgaaaggcacaaataaactgcttgaatacagctcacagatagaactttgtgtctttcacacaggcttattccttttctgtatgatatgatgtatccatagggctttcattttattctctttttaaaaaatacttaaattacgagctgaagagatggctcagtggttaagagcactggcaactcctccagaagacaagggttcaatttccagcacccacatggaagctcataactgtctgttactcccattccaggggatctgacaccttcaaccatcatgcaagcaaaatgaacataaaatgaaaataaatcattaaaaaaataaaaatgacaaataaaaattaaaaatacttaaaaaaaaaaacatagccaggcatggtggtgtacatgtttaatcccagcattcaggaggcagaagcaggcaggtatgagtttgaggcaaacctggtctacaaagtgaacacaggatagtcagggctacacagagataccctatcttgaaaagccacaaaaccaaaccaaaaccaacccaaatcaagcatgatggtgaactacaagttctgcttcataaaacacgggaatagtccatggcttctaaataactctctcaatttcacaagacccaaagttaaaaaggagaaaggtttacagtaatttcatatataagggtggtggcgtgaacaagcctgaaagctgaatatgaagccatagctgcttctatggttacatgcaagagccgtaagtcaaaactgactggacccacatgcctatgtagtggccacagttagctgtcattgaaatccagtcttctcagatctttaggttttatgagaaacaggctagatagcacaaatcttttgaacattacttaactaattagtgacgtgccaggggtaggatctggaacttcatacttgctgggcttcacaccactgatctgtggtttcaggactctaagtttttaaaaattatttattcattttgtgtatgtgagtacactgctgctgtcttcagacacagcagaagagggctttggatcccactacagatggctgtgagccttgaactcttccttcttagggctttcccctcaaatgctggcatcacagacatatgctatcatgcatggtttattcggtgccggagattgactttagggctttaggcatgcagtagagctttaaccccagcctgaactgtcatttcaaagatttttttgttttgttttgttttaaatatatgtatgtatgcatgtgtgggcacaaacatgtatgtgcatgcaagtggagatcggagtctacatgtgggagttggttctctcttctaccatatgggtctggagattgaactccagacttggcaggcttgtcaccaagtacctttcctagcggaaccaccctgctgtccctaggataaactctttagttaaaacaaagcaacaacagaaagaaggatatcagagaatcagcatcatctcagctttcactgactatcctattagaatactcagcacaaacacatgacttgaaagcacgtttctgtttcagtccctttggtgcagttattgagatggacaaagcataaataagtcacaggagagaaatatcttttttttctttttcttttttggttttttgagacagagtttctctgtatagccctggctgtcctggaactcactctgtagatcagggtggcctcgaattcagaaatccacttgcctctgcctcctgagtgctgggattaaaggcgtggagaaatatccttgataacattaaaacccaaaactttgtttcttagtgattgagactggctacactcaggatgggaaatccaaatcatgtaattcacattgaggttttaaaataacatcatggaagttagtgattataacttctaaaagatacaattaaaaaatgatgttgttatctcttttaacacttgtagaaagccagttgaaaatactatgcttgtattgacaagcaaattaaactatatttaaagcaaagctctgagctactggtggttattaaaggaatcagtagtctacttccaaaaagtcagagtggagcagcacctggtaacacacacctataatcccagttgcttaggagaccgaagcaaaaaacaaaacaaaaatcaaacaaacaaaaaacaaccatgagctcaaagccttcctgggctagagtctaagataagctcaggccaggtatgtagaagtgtgagggtatttttttccttaaaaatttatttatttctggggctggagagatggctcagcttccaaaggccctgagttcaaatcctagcaagcacatagtggctcacaaccatctgtaacaagatctgactccctcttctggagtgtctgaagacagctatagtgtacttagatatagtaaatctttttaaaaattgtatttcttgggctggagagatgggtcagtggttaagagcaccgactgctcttcttaaggtcctgagttcaaatcccagcaaccacatggtggctcacaaccatccgtaacgagatctgatgtccttttctggtgcatctgaagacagctacagtgtacttagatataataataaataaataaatcttttaaaaaattgtatttcttatgtatacagtgttctacctgcatgtatgcctgtgggccagaagagggcaccagaacccgttacagtcagtctcctgctgatggccagcaagcctcgtgacccttctgttttcacccaggcctagcttgtgacatgagtgctgggatttaagcgcacatgcttgtgcagagagggctgttacccatctctccagcccctttcatcacatttctttttcattactggaaactgaacatcactctatcactgatcccagcctgttaatcgtacttttcaaagatgtcctcccgaactggagaaaacagacctgaaataaaaatgaaattttaaagtagacaaaattgaggtagtgtcctaaattcatgacacaactagaaagaaatgttactatgacgtgttcaagggtaagagctttcttcacctttgaggattgctggtccttctggttggcttctgctgtagctcagaattattttaagtcatccttttgggttttcctttttttaaaaaagtaatccatatatatttgaatatataaattaaattgcatttattgaaaatggtgtaaactcatattaagtaataaactattggtaaaggctaaacaagtgactttctctttccataatttctttagcattaaaataaagacagcagtgttctgagagttaaataaatcatggaaacagttctaacacataataagtgttaataaatgtcagctctttttattttcatataataggctggttatacttactcttttgttgagacaaatcacgggccacaggctgcaccccagggtacagcagcagcagagacatccacacagcagccatttcacattgacagggagagcctttttcaagcatgagttcacacggccaatgctggtcttaaattcttctggagccacctaaaatagggggactctctttaaggatttgtgaacagctccccactacctctaatcctaaggaagacgccttatcccaaatatttcaatgtctcaatatagtctctccatacatctgtatcatatactcttggaagacttagcgagtaaagcaatacaatttcatggttcaagaacttcgcataatattcacaatgttctgaaatgaccaacaataaatggaaagcaacaggactgattggaatggaaacccatcaaacacttttgttagcaaacattcttgttaaggcaatggtgctcacagtcttcaggcaccctgactcaaagctgggctttggttagaagcgtaagataagactaaaacccaaacaactacccagaggaaatgcaattcaagcaggcattgataataatccccaattactttgaaataaactctcttaataccttttctttctggcaaatctgtaatataatagttaaaccggctattgtttgcattaacaaaaaagtggtatctggtttaaagctatctatcagtgttcagcccacataagactcataagtactccgagttttgaaggttgaaaaacccttcacacaaatttcatatttctagttaattacctctgttcctgaaatagttgcttgtgtttctctataaacaatgatagagcccactcaaaagcatgagtgtgacccatgtgagttaagatttgcaccaaaattcttcttgcaacttacataattcaaaggaacactaaaaatagtatgctttcagtaaaatcatatttctggattaacaagatgataccatgtcatttagaaaggagcagatggaaaactcatgtgaacaatttcagcatctggctataaaaataaaacttgtgatggtggtaaaaagataaattgctgtaaaatgaaagctacacaatgatgtgtgacatcacaaatctaaaagcttcactcttcacacatgtgtgtgttttacttttaacagggatgtcttagaattcacaaacataggtattaatggatgctataaagattcagttcagcactataactgtgaaaacattacgcagataagctttcctagaattgtggcacctgtaagttaattacttactccataaactggctattcttgctaacaatgaccagttttgaaactgtagaacttaaaatgtagtttatatagggaaaatgggctccactttccatctacactgctaacaatgtgatatactggcagtcattgggtaccaggaattccaattaagtaacatttctgggggttaatataaaaataaagtgagagtgtatgcaatggtgtcagcgtttggaggctgattatgggatggatccccggatatggcagtctctagatggtccatcatttcatctcagctccaaactttgtctctgtaactccttccatgggtatatgcctcagtacaggggaataccagagccaagaaggggagtgggtgggtaggggaggggggagggacttttgggatagcattggaaatgtaaatgcagaaaatacctaataaaaataataatgaaaaataaattgagagactcatgctataaaattgaaatgagaaaacattttaaagctaaatcagaagacttgcttctacttcatgccatgtctgggaaaaaccacagataatatcatttaatcttcttaaaaaagatttacttatttatgtagtgttctgcctgtatgtatgcctgtaggccagaagagggcaccagatctcactaaaaatgagtcgccgtatggttgctaggaattgaatttaggacctctggaagaacaactagtgctcttaactactgaaccattccccccccccctttttttttatcaagacagagtctgtgcagacttaactgtcctagaactctgtacaccagtcttgtccttgagtcaacagaaatctgcctgtctcagcattccaactgctgggattaaactgtgtatagtaccagctaaagtcaactcatttacttaattacaattcctcatatataaggtgaaatggcatagtttttgtttttaattaatttattgtattgtattaattaatatattttatgggtgagggttgtctgcatgtatccctgcaggccagaagagggcatcaggatcccattatatagatggccacgagccaccatgtggttgctgaggcttgaactcaagacctcttggagagcagccagtgctcttaaccattaagccatctttcctgccctgatataggcactggaaatcgaagttctaatttggaaggaatttcttatctagaatactttggaaaaaaagtgtaaatcacatctcagatgtagagatagaaaagtggttgcctgagttctctgatcagatgtgcatggagagcctcagttttcttacacatggattacaaataaaggataatctgcagcgtgttgagggaaacgtcaatgatcttcgggtcttgagtttctcagagctattctgtttccctgcttccttcctctccccttttttcagaaccagggctggaagccaggggctagcccatggtaagcaggtatcctaccggttattcctcctgcagtcctttgctgttcttttaaaaaaaacaaggtgccaagttactatgtaaagatttatgtgtcccaaacagaagcacttaacttccttttcattgcagggaatcaccaagtaacagttaaagatcgtttctatctagcaggactttctcagcacaagaccttctacctgagctaaggcctcgcagaatcccgggaggggccagacttctcaggcccctattctgtcctgactgcgtaacattggttcctcctatgaacaggctataatctctttccttttgctagaaaaaaaatctcgagaataaatgaggtaacaaccataaagctactttaggcactcagaaagtgcagctattgttcatatctcctggtaagactgcaggcaaaacaagagtattaattgcattctttaagcatttaagcactgttggcttaacaatgtgtatactttgaaaaaacaggaccatttacctcactgcctgggagtgcttatggaacagcatttcctactatcttatgctttattcctctcctctaaaaaaaaatctagtggatataactgtagtcactctatgatgcaggcaattctgtttttttttctttttaaagaacaaaattgatttcatattgtgacaataaattaaaaacaccatctctctctcagatgaatataattttatttcagaacggttattccgagaaggcttactcagattgtcaccttaagcttgcccctacaggccttttgtgttctcatggagtggcctgcaccagctagcgccatggaagcacatccaccccggtttggatgactggaactctggtgtcctcttcctcatccaaacctgacttccagctctatggtcagctaccactttgcagtacgaggagatgatctacagtgttgccttttttgagcttagcttatttagaaagtatctgttacacatatgtacttatttatctatctgtgtatgtgactacatcgtatgccctgcaggagtcagccactgtatggctctcaggacccagctcaggctgtctggcttgttggcaagaaccttttacctactgagccatcgtgccagccttgaaaggactttttaaaaaagtttgtgatcatgactggaacttttatttaaaagcagcatgaaagtacagatgagaaaattagaagaaagacatagaaacaaatctatccaaaagaacaaaaccgcgtataagggttctttaaaaaaaaagtttctttctagcagggaagaacagtgtagtagaaggctgagggaagggaaagctggcttgcagtctgaagcatgaatgaaagcaattataatagcacagtatatcctatatgtggttgattacatggttcagaaaatgaaaacaccaacacacctcaaatttgacacctttccgttttcaacactccgtgttttaacagatactctcttactactgacggactaaaactcaaaggttcaagttactacaaatgagaaatcaaattttgagtcataagagaagtatattgagaagaaaaactttcaccagaatcttaaacaagaaactacagtctgcactgactttaaaaagatgccaggactgggtttgggaaataaaaaccgtatttgagtaacagtataagtcataagacagacagggaacgagaatcaactaactcaactttaaacgtgtttggttaactatagattcgcggttattccaattggactcattcgcttctatacaactatttctagtattattggctaataatagtattggttaggagcctctgactttctagctggacagtaggttgtaaagaaacaaatttcattccttttgactctctcagaaataaaaaagaaaacaacatcaggaaggtgggggaaaggtcataatattttataacaggatgcaggagactctgcacagacaaaaactaaagcaaagcccagcaggactgatgtgcctccctcattgtgaggaacacaagcctatcaatcgtcatattggatcacaatgggggggtgtcagtttttatggctccccattgctaacactacacactgcttgccccataatgctctttgctgctttcaagctgagcaccagacactttcatttcctttggaaaacttaatgtgggtctttcactttctggtcaccagaatcttcctgtgcgtggataaacacactcatctacacgatttgtcctatcatgacagaactcactggtctgtactcacaagaattaacacaaaagaagcaaaaatggttaatagtgagttgtggagtttctgaaagggccttttaggttttcctaattcactgcatttttgtttacctcaaactggctacttagactacctcactcatgccaaaagactgatttttttttttaaataaagggtaactcttttctgttaggtattagaattatccattttacgacagtttacacaatgagtcttaagttggtaattaagaccttttaatttaattttttcatatttatggaaggcctccccttactacagaaatggtttaataatccacactaatctatactaatgaaacagtacctactgaagaaaacagattctcattaaggaaatcaaacttgaatttaggttataaacatgtaacttgaaaaatcagaccttcaggaaatagaaataaagcccagcggtagggtacatgcttagtgtgagcacggcactgggcttgatccccagcaacaaaacagacaccggatgctcagaatcggttttagtgcttgtctcattgttgaccacattttaagaaaatattgcactatcattctacattacctaatacatgagaaaatgcatatagtacaaactacacatacctgaatgtatatgaactataaaactaaccacctagccaggcgtagtggtgcacgtctttaatcccagcactggggaggcagaggcaggcggattcctgagttcaaggccagcctggtctacaaagtgagttccaggacagccagggctacacagagaaaccctgtctcgaaaccctccacccacccaaaacaaacaaacaaacaaacaaaaaacaactaatcaccagaagagaatacatgttttagccaggcatggtgactcatgcttgtaatcagaacaattagagagctgaggcaggaggactgccaaaagtttgagaccagcttgcattacaaaatgagttcgaggccagcttagagtacataacaaaactctgtttccaaaaaagaaaggagggcagatttaaatggaggaagaggaggagggagggatattgtcaagaacagcttccatccagatcatctaggtagtatgaatggttatcaaaagcagcttaccattcttacaactccaatttaaaaacatcctagtatcttttgtgtcaattgaaatttttagttgcagaaaaattggaaaggaatgaagaggtgtgaaaaaatattcaaaagattacttcagcacaaaaaaatggctaattaaaaagtggctaacgtgtatgcctgggagctatatttgctgacagtttagcagatattcattttctaaagctataattttaaatatgtaagaacaattaagtaagtattcaagctgcatataattccccagtcaaaacatgcagtagcattaatggaaataaattctctattggagattttttttttgttattgttgttgtttttgcttttttgagacagggtttctctgtgtatccctggctgtcctggaactcactctgtacaccaggctggccttgaactcagaaatccacctgcctctgcctcccaagtgctgggattaaaggcatgtgccaccacggcctggctgtttgtttatattttgagacaagttctaactatgtaacccagactaagtctggaacccatgatccttttgaatgctagtgctgggtttacagacctatgtcattgcaatagctcaacgtgatattttaatatacatatgcacgcctagtgaaataattactatagtcaagcaagttaacatatctccttacgtagttatttatcatttcttttagagaacctgaaatctgttcatttggtgaattttcagcatataatacaatattatttataaccatcacacagtacattaacctagacttatgtttgagtcctgggaagtctgaaatttgagcatgaatgcttctctatacaactgattatcgggaaacccagaaatagaaaggtagttacttattggtgtgaatccaattttagaaactcaagctaaaaggaagaaaaacatgtaaccaaaaatatgatgctttttatttgtaataaatgatgcataccatataacacttttaaaaaataatagtgactcagttaaaaagatagctttggcaatgaaagattggaaattatagatctaaatgaaaacaattacagctacctgcgctgggcaaaaaaggcaacactggaaaagctgagcaggtaaataaacaatggctgacattaaggaagaacagacgaaatagctggccagaggctggtagtcatggaaacaccatttagtcactgcacacagcttccaagcagggaggccgcctgttatttggcttcattaccagtgagtcaaagcatttgtcataacattgaataaaccataacacagtgcattagaattggaaaattcaaagcaagcccacttaccttccctgtcagaactgacggaaattcggtatcaaacttgttgctcaatccaaaccttaaaaacaaagacagaacaatatctattctattcagcatatttaaccctttctcacagtaagttataaaacccatgaggttttcttttggtcttcagactcagacaattgtgtcctgaatattcacaactttatgatgtatgtgccagttaaaaccaaacaatggattaaaaatgcatacgcaagtcctaaaaataacattacatttttaaaaatccattaaatccaacagatatgttctgaataaaactttacaggcagatatctgagttcaaggccagcctggtctacagagtgagttcctggatggccagcgtgacacagagaaaccctgtcttgaaagactaaaaaccaaaaccaaacaaacaaaaaagctgggcgtggtggtgcactaggtgtttattcccagcacttgggaggcagaggcaggtggatctctttgagttcgacgccagcctggtctacagagggagttctaggacagccagggttgcagagaaaccctgtctcgaacaacaaaccaacaaaaaccaaaactaaacaaaaactacagaaagtaaaactatacttcctttttcttttcttctttttctttgcttttttttgtttttgttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggctacacagagaaaccctgtctcgtacttgtaagaaacaaaaccaaaaccaaacaaacaaacaaacaaacctgattttatgagaaacatatagacatctgtgtctgtgggagattggctctgagccagacattggatatcaaaattcctggatagtcaagtcccttatgttattttttattggaaattttatatttatttgattttattttatgtatattttgcctgcatgtatgatgtgtgccatgtgtatccctaatgaccttggaggtcagagaagggcatcagacctcctagagctagagttagtgatggtcatgagcattcacttgagtcccgggagctgaaggtgaacggcattctgaatcactactttctgaaatctaggtaggaaactctatagtactaggggaaagtcctctgtaagggcaacaagtgctcttaaccgctgagccatctctgcagcccccagttccttatattaaaatggcatagtgtttgcatctaacccatatacatccttctgtattctagattatcctagtaatagctaaaacagctgctatgcaaatcattgctatgctgtgttgtttatagaataatgctaagagaaagtctatccctgatcaatgtagatggtgatttgtttcagatatttttgatctgcaaatggttggatttgtgcaaaacctgttagtgtgataccataacatataaagaagatggcagagtagcacatgtctataatcccaggatgaggcaagagatagtgagttcaaggccaacctgggctacatagtgagttcaaggtcgacctggacaatatattaagaattcatcttaaaaataaaacaacagggggttggagagatggttcagtggttaagagcactgactgttcttccaaaggtcctgagttcaaatcccatcaaccacgtggtggctcacacccatccgtaatgagatctgatgctcccttctggtgtgtctgaagacagctacagtgtacttacataaaataaataaataaatcttaaaaaaaatcaacaaagcatactgaaaagcaaacctgacccattactctcataattttggctaacaaggaatagctatcctcttctcacttaccagggatttctttttctttttcttttttgttaacattgaggacataaaaagggtgcttacttcaaatagccttaattctgaggctttcacttagtagctacaaatataatattaaaatagctgctggtgaatgaataagttttctctgtttcataagcgaactatgaagttaagaactacggctacacagaaattgcacaaatgcatctattcattactctaagccaagatgtggcagtcttcagcattagacaaagaggcacttgggaactattcataaagtcattttattgatgttattaaatatagagtctattatgtgtttgaagttgaccaagctggtggttgtcaaagattgaattctctttaagtgttttcaatgccttttaatttcttgaaacaattctttggatgataggaaatggaggcaaagaaggatgcatcctaccctgcctctctatagccctggctttccatccttgtgaagacgactattttcaatcatttaaaccttgcataaatgaatgttcatgtgctcaggttaagagtcaatacatataaagtcctgtaacaagagccacaattttgctagaaaactatatacttcataagactgattctaaactacatgtagtgtactctactgtacttaggaaaaggaaaattataccctataatacagaggtttttttcagttttgttttgtttttagattctacttagatttccttaatctttctcatcagactacaaaatggcttaaagccttgtaaaatagttacctgattgttttcagtgttggggactgagccggggccttgctcatactaaccaaggcctctctctgagtccataaagttatactatcagtatatcactgtagtctttcaatgacaggtaacaaaatggtaggccattctctaatccgagaagtatctctaaatttgtttagaaacctgctgtttgtaaatttaaccatctgttttggttctatatctaatgagactccctaaaaaacagtaattcagcaattatctcaactaaattacacgtactctagcaagggcagacttatgcacattttaagtaataagtatgatcatattttaaaacacaaggggaaaaatatctgatcagatgtatgttttctgtattttaatacaccatgccccgatatttatcctaaaaaagaaaagtataagtcacataaacaacatttttgaaacatttcatacttgcaagtgacattcatcattttgtttctttagtatcaaacctgtggaagttaatttagtaattttttttagacagggtctcactatatagaccaggctgggctctaacagctataaacatctgcctttgcctcctgtgctatgaccaaagggacgccccaccacatcccagtttcactttagactatcaatatgtcactgtaatctttcaatgataggtaacaaaatggtaggccattctctaatccgagaagtgtctctaaatttgtttagaaaggtactgtttgtaaatttaaccatctgttttagagagtgtcattaatttcatgttaaaattcatattttgttaaaataactagaaagccaaaaacatgaagatgatacaagtaaactggagttctctgacccacaggaaaacttaacaaagctttatagaggagagggatggtgatgtgaggatccctcatcactaggattctgatagtatcacagctatgtgaagtcctcttcctagcatgattcaacaaactagcatttgttgagggcctgtaataaatctgacaaacagacatagactatcactaaaatgaactaatagtcattgaatgtacttaaacggggactatgataggcactgaagattcatagggaataaaagattgttcttgctgttgtagcttacaatttagtgatggcaaagaagactgacagaaaatggtgacatttggataattaaggtgaggggaggtgtggattggcatttcaaatggaggcactagcttgaacagacataagataagaaatagcaggctgggttggtgacatggctcagcggttaagagcactgactgctcttccagaagtcctgagttcaattcccagcaaccacatggtggctcacaaccatctgtaatggggtttgatgtcctcttctggtgtgtcggaagacagctacggtgtactcataataaataaataaatcttcaaaaaaggatatagcaggttatgataagtagcatccaagcaacaaaggaaatagaaaaagatgacagagacaggttagatccagttttggatgccatgttccagagcttggactctatcctgacaaggaaggagaaactagactaagcttaatcaggacagcagttcatttagctctgtacttttggtattttaatcaagtaacaggctgaaggacagatgttagcgtgacaaggatagaggtaagacaactagttagggtagaaaaagaggcctgaatcggagaagtggcactggagaagaatataagcaaatctaagtcctatatcaatcattttttgatgcttcactttgggaaacatgagaagaaaagggaggtaacaagagatacacactcaactgaaacggagaataaagaacaaaaaggcacatgagagtgaagtagtccaggtaaaagcctcagtagtgtctggtacagagatacacatttggaaacactggattactagatcacaagaagcaagaagagaccatttaagatgtgtagacagtaaaagtagaggactaagcacaaaatcctgaagatcactggtatttaagaagcaagaaaggaagaagactgtgaatgaaaaatatacaccgggcaagcactctattataaaactatacatactaccaatgtctgatcatagtgatctcgattgaggccagattcttcacagttaaggtggcagaacccagccgagaggaagtatctatggcatatgtatgtactttaaagaaatttggtgaagagagattagagggcaggtaaaagggatgtgggtatcagaaggtttttgtcatagaaggattgaataaaattacaggacaatctagactagattctaaggagaatcaaagtaaagcactattggagccaggggctaacacggaacaaagaccttgggtggaggctagaagagaagggtatgaaaagcagaagagatgagttttaggtaaggaactccttgaattgcaatgttgggaaaactcagatctaataaagagccaatgcagatttgtagctgtacaggacacgattaaatggaattttaagaaaattagtttggcacaagcatacacaatgaagcggggagaggcagcaggctgtgcctataattcaagaaggggatggcaactcaagcaagagtattgccaaataggaatagagaaaatgaaaaatcttaacaaatttccaaatatatgatgatacaattctgggaaaactggatatagggcaattcaaggagaagaatcaaaatgactcaaagatttcagatattaccctgggagagtagaattttggtgttaccactataaatgtggcaactagaaatacaacccatttggggggaaaaatgttagccgggtgtggtggcgcacacctttgatcccagcactcgggaggcagaggcaggtggatttctgagtttgaggccagcctggtctacaaagtgagttccagaacagccagggctatacagagaaaccctgtctcaaaaacaaaacaaaacaaaacaaaacaaaacaaaacaaaatgttgagtgtaagatacactgagttacaatcaggttaaacatactatcttaaatatttatctcctagtcatggtaaaaagctacaaaatacttccgtcttttttaaaaatccagttgatggcaacacctcaatttttaaactttgaatagaagcaaatcttctatagatgaagactgaacagaggatagaaaaaggccagtatacaggagaagaagaaatagttcactcacattggtacagggccagggttgtagctcagagatacagcatttgcctggatgcacaatgctgtagtttgagtttcatcaccacaaaaccaaagaaaaccaatataacatatagtttagggtaatcaacacatgcctatgccagaaaaaaaatgaaacaaaaattggtattttagatgtattagtttaagattatttgttaaggattttgcttcatttgacagatgggatgttctgttattatagttcatgtttctgataccaaacaaacattttactaacaacagggtctcactctgtagcccatgccggcctggaactcatgtgttccagtttggccttgaactcatgacactctccctgttttaatctaccaaatgatggtatcacaggcttcaccatgtctggcttctaaacatttaatcttcttcttaaaaatgttagatatttagcattaaatgttcttcctaaatgagaaaatgtgtacaataaagctaaacaattttcatgtttagtaatttaagactggcttacacttttcagagttttcttcaaataattaacactaagatgctattagtgccattcctttacacctaactccagaattttaaaactgtgtgtgtgtgtgtgtgtgtgtgtgtgtgtgtgtggtgatagcagaaaattatacctataagaggctagccacagcaaacctcagagctctgttttaaatgagaacaaggaaattggttgtgtggaaaatagaatggagccacaaagaagttttagagaacttaaattatgcttccttgctatgtaatcattgcttgaattgtagaaaataatggggggagttggaagataaaattatgggtcaggatagaaaataccttttctttgtctagtcatggaaaattatctgcataaaaagtctggaaaacgagacagcaagtgtggtgggcatgatagtattttagaatttcatggaatgaaaaacaaaacaaaacaaaacaaaaaagaagcctggataccagaatcataattagtttgaataatggtctccctagtgacaaaagaaatggaaggaaaatggtgcaggaagttggcacctgaacattacaggttatctgcaaaaatcttggactaagaaaaaaaactgtcttcaaattacctaataaaaaataaggcccaaaagtcacctccaaagccttccacaattgacaaacatttggtaatacatacattcaatgatttaaaaggtgtattacagtcaaaatagttaacatgttaaaaattaagagatagcgtacacactggatgatttcgtactagcactcaattgagtcaaagggactatgtgagccatgataaaaattaaagagagtgtgacttgataggaaggcgcaaatatagtttgaaaatgcagtaaaagacaccacagtcaagagcatgaacacgacaccatattcaaactctcaagtatgtgcaatccaagcaataaaaatgaggaagcactcttcaaagcccagtgatcaatttttttcttactgtgcaacaaagatgataagaagtccttgcacactttatttccttaaatatgacataggattcaatgtaaaagaagtcatctgggttgagttttaaagaaattaaactcaattcattaagggctaatttctatatacttaatatacttaatatttgtatatttaatgtctggacatacacgattccctgtagacatcttaaattatttcagagccaaagggggttagaaaccacgcactcagaacccttcattttggagatgaggaacccaaggcctggaagtaagaatcaactgaccaaggtcacagtgccagtaagaagggaaactgagatttagcaaccaagatctctcactctgtatccattgctctttctactttgcataggttcctattaacctgaaactctaaggatatgatattaaaggaacgtcagagtagtgcgttcaacagagaaaggatgacgatattcattcattaggtaggaagaatggatggacaaatatgtgggtggatgaatacttatattattcacaaaatgcatcacatttttgttttgttttgtttttgaagaacccaaacctagatcatgtcacctgccacagcagtcgccgttttccactagccatcaatcttggcagcagagaagtctagtacatcctgcagtttagagactattcacttgccagcgcacgaacgagcagatcgcccctacttcagtctctctggctccctaccctgcaactccatgtcctatgctcactctttcctcagggtcgatgcagcgttatctcccacccccttcttttacacgatacctattcaacctgcggttttgccattttgaccaggtgccctttgctaagagtacgctttagtcagccctccccccactccgcaggcccctcaatgcccttctcattcggtttgtcgtcaaatctcagcctctgcaagcccccgaccccaatcgcttacacagtgatgtggccggcgccgcgcaccaacacagggtctggggcatatctccgcagatgctcctcgctcactacccgaggcgggggcggcacctcctcctcctcttcttcctcgtcctcctcctcttcatcctcctcttcttcctcctcctcatcttcctcgtcctcatcgggcccagataccgacgacgacgacgacgacgacggagacgacgatggagacgacgacgatgttgctgcctcttcttcttcctccaattccgagatggtgtcgaactccgccatgttgggcagcaggatgctcatcacgtgaccgcacgatagccgccactctcccggagaagagtttgaacctgcggagctgctgggagaggagggggaacagactgaagagaaagaggagggggcggggaaagcgcttgaggagacgcgcctgcgtgttgggtagatggcgcgggggttggaggcgggggcatgagggaccagggagtaaattcggtgtacgcttgcgcgcctccaaggggagggggccggtagaggtgaactccagggaattctcgaggtccggtctgcgggtgctgatcttcatactgcgtttcggacgtcagtctcttgtacacaggggacgttctcgttttagtgtctgttaattaatgcgggatatatttgcctttatgcagacagttgaggtaaagcaaattctataaaagagagtttaggacattgcccaaaatatctcaaggtacgcatatgtcattcccttacgcagagattgttcaattctgagaaaagggtaaacatttttcaaaggaggaaactttctattaatttcttacgttgaatggtactttgcggacttgctaagcatcatagactgtgctaagtgctctgtgtacttatctcatttaatctccccacaaccctatgaggggtgtaccacattgagtctcatatcacacaagggcaatctatatacaaagagaataaataatttgtccaaagacatggaactaataaatgacaatgagcttttaaatccagagtctcgtctgactcccaaagctctgttcttttagccaaacagccatggtgcctaaagttgattggaaagaatgggcgaagtggtgcattttggttggttcttataaataaggatacacaggtttgcaatgggtgttctgaagccggcatagtggcacatacctctaagcccagcatttgggaggcagaagcaggagaatcttttgagcctagcttacagagctcattctaggacagctagggttacaaagagaaaaagagaaacccttctgggaagggagggagggagggagagagggagggagaaagagagagagagagagagagagagagagagaagggagagagagagagagagagagagagactggggttggagaagaggagctgtagagtgtgcagcagagggtatgccagtttagagacacattaattaacgtcacccattctatagattccaagctgtattctttcaaataccatagctcatgtaattcaaacactcttgtgaggtaggcatctttatatgtcttttatagatgaagaactgatgggctggagagatggctcatcagaagcactggcttttccagaggggcctggttcaattcccagcacccacatgcctgctcacaagtgtctgtaactccagtttctccagggatctgacacccttacataggcatacctgtaggcaaaacactgatgtacatgaagttaaaaaaatcattaaaaaagaggaagagttgaatatcagaaaatttaaacaattcattcaggtcggtagtgacttgctctcttttttttcccattcaaacattctacctcatctttacattgctaaaatacatagattacctattttgagttactaggtaatgcaccaactggttcatatctgtcagtggcaccgaattttgcaattaagactataaagttgtgcagctcctctgtaatagaataaatattgaggtcctctatactaataccagcttttcttctccttcagatgtagtagagcatccattctgacagaactgggggtttagaatgagcctggtatcagcagaatagtggtaataagcaaaatatttgggcatatgaggaggggagtaatctgttataagagagattgttcaaaatatcaaggaattggcgttattaatattaaatgtttccactatattcaatagcttggctattttggaattgaaaagtaagctgtaacattttctataaggaataaatgtagcattttgttgcataaagagcttttctttagctagagattaggataaaagaaagaatcttaaaatattccataataattgttggctttcctggtgctttgaaacatatatcaacagcaagattgaatgaccttagacccaaggaggaaaatatttcccaaatatcttatgtataaagaaagagtttagtatatcaatatttagagggaatagtagtatttggctaattactgccttttttttttactgcttaattactagcttctgtttttatcactcaaaattagtctaggaaggaatttttgacagaaagggaaaggagtaagatatggattttgtgatgaatgcaaaaagtcattggaactattgtaaaagtaggagatagtggctaagggagaccgaaaggaagacggaaaagaagggtagggcaaatgctactatatgctgcaaagtagagagtcccgaaatgtagttcagttggtagagtgcttgcttatcatgtaggaaatccctagttctaatctccagcacagcataaactgggaatggtggtgcacatttgtaatcccagaagcagggaggaggaggcaggaagatcagaagttcaagttgatccttggctatatagtaagcaggtcagtctaggacactgagacactatctcaaacaaagtaaaacaaactaaataatttggaaagaggccgctgacatttagtcagaagtcaaaaggacaaagtagtttagaggcgtgttacacttggccaagtgtgcaagcacagtcagatcagctcatctgtttccctgcatgtacactgtgctgaagaagcatatgtggttacaaaggcaatcagttgcactgaacgacaggaggagtcttagattgggaaagcacaggaaaacacgttttgtgtatccactgtcagtgactacatgaagcatgatgatttttaaatgataagttagctttcaggatagtaaattggggaatggatagggaggaaagcaggtggaaaaaggttttgtttgcctaacgtgctaagaaggtcatgagggtcattctctcggctaatagatggctgactgaggcacaaagtctcaggtttaatggtctgagagggttttaaaagatagtgttgtttgttaaagtatgcatgttagtgatattagtcaatttacagaatggtgcagtcatcatcagaaactaattttagaatatttccattgcctcgtttttcaatagcccctgccccaattctcatccccgatcctatgcaacaattagtctgtgttatgagttagtatttctttagcagggcttttcaaataaactatattataaaatacattgcttctgacaccttttgcttagtgtgtcctctaggttcttcatattgtgtcatttattagagcttcattccttttaatggataaatagtattttattgttgcagtagatcatatttttcttatccactcacctggtaatgacatttggattcctttcatcatttatatattatgtaaatactgttgtggacattcatatgtctctgtaaaacatgatttaattgttttcttgaatagatgtgtataagtggaattctgggccatctgcttaagactgtgttgaactttggggttggagagatggctcagaggttaagagcacatactgctcttgcgtaagatctgaatttggttcccaacacccattatttgggcagtacacagcctgtaacctcaacttcagcaaattacatgcctctagcctctgcgggcacctgtacacatctgaacacacacaattaatgataaagtaaaaggatttgtttttacaaagattgtgttaaacataataaagctgttgaaggattttttccatactggctctatcagttgacattctcatgaagtattctctggttatttatttatttttttgatcatagcttctctgtcttttaaatgatttattataacaagtcaattgccaccaccatttataaatatgaacgaggtgtttattaacaattttgtttactgttccttctttgttactgatagtgtaagagatttgtctttcctatttagtctttgctccatcttctcttctcttctcttctcttctcttctcttctcttctcttctcttctcttctcttctctctctctctctctctctctccctccccccctctctctctgttttaccatgctgggaatggaaaccagggccctgcacaccctgggagaagtgcaaaccctaggagaagtgcatacactgggaggggtgcccagacactgtgccactccttccccaacccttgtacttgttcttcagaattgttggcaataaattaccttacttttcctggtctgacaaaatgttgatcttactttcgttcctgaaatgtcttttttttttttaaagattttatttattattttatgtaactatatggtagctgtctttacaaacaccaaaagagggcgtcatatcttactacagatggttgtgagccaccatgtagttgctgggatttgaactcaggacttcaggagagcagtcagtgctcttagcggctgagccatctcatcagccccctgaaatgtctttttactgggtgtttaattctggactgacaatagtttcagcacttgaaaaagaccatgccatttgcttcatgtgtccagatgtttagttaaagaacaatctcttgcttttgagttgtcagtgatattttgtttattcattggatgcattaaatatttttctttgttgttaatatttgaaaatgaaattattatgtagtgtggtgtggatttatttgtcctaatttgaggctcctcctctacctcctttttctcttttctttctttcttttcttttctttttttttttgtttttgtttttgtttttttgttgttgttgtttttctgagacagggtttctctgtatagccctggctgtcctggaactcactttgtagaccaggctggactcgaactcagaaatcagcctgcctctgcctcccgagtgctgggattaaaggtgtgcaccaccacgtccggctttttttctcttttcttgagacagagtctgtctatgtagctctggctggcctggaacttactgtgtgaaccaggctggcctagggcttgcagatatccacatgcctctaccttcagaatgttgagattcaaatcctgtagcaacatacccagtttcatgagttgttttcaagtaattgcgggtattctcatattaccttatgagagcctggattctctttcagctttctcttttgactgaagtctgctggctttgctcccttagggaaaggtgagctgctgtatctttatgtgttgccctgttggaggagaaagtccactttccccattgacttgattaacactcagacaggggtccttggtgctgctggatgaggtaagtatttgggcttatgtcatttgcactaaccctgaagattcctgggtgtgtgtttggcctactttttcaccagtgtgttgttgttttgtaacttcagaagtatggaagacaaagcaacaagtttggccttgctgtgaagatgaaggcagaactagagttcttttctatggtgttaacacttactatatagataatttgaccatctaaagggtttccagttagctgtttccagttttccttttctagttctttggctagaaagagctgagctgggactaaatttatatctgtctcaactactcttgctgtggttctggcttcttcaaacccaagactggggtagatgaggcaataagaaatcccggtgaggaagagggcttagaatcctcaatgatgtagccccaggtaagttttccttgctcaaataaataagccccacgcacattcatgtaagcagtctaattaaaagcagcaggttacacacatgtacacacacacacacacacacacagacaaaaggagaggagacgtttgttgggaagaaggggttcagtggtaataacagagcaatggggtgactatgatcaatattatctcactacgtagccctgacttacctgaaactcactgtgtaaagcagtcttttgaactcagagatctacatgcttctatcttctgagtgctgggattaaagtcatgcacagccacgtctgtccaaaaattatgggtttgatttgttttctaactccctaaaatagaaatctgtgactgattttttaaacagataatatcattttattttagagcaaacaatctaatattgtttagtataatcacaaatgtttgaaaccataacactctctaatgccacaacatgattatcaccccattaatgcccatgcccgctccacctctcctgtcagccgctgggaaccagaaatctactacactgtgtttcagtggatttgtgtgtcctggacagtttatagaaatagaatgacacacaggatgaagtatttctgttgggcttgttttgtgtgacacatgcttttaagattcaaaaatttgctagcatgttgttctttgaatggctgaataaaattatggttatgaataacccacattttgtttgcattcttcaattggtgactattaggttgcatctggttttccctattatgaataagaacaggaacaatacaactactgggaataatgcagcttttagtattccatacaagcacttatgagcgtgtatttgcaagtttcttacaggttacacacaagaaaaatttgccaggtctcatagaaaacctatgcatttttctctaagaagcaaagcaaccaatcttttctccataattgtacctgtctaacagctgtgtccaaagatgctagtgttccagtttcatcctcaatagttgctgttgtctgtcttattcattttgttaggtatcctgtatttagtccttattgcatcatgtatacaatggcatttcatccttctttagattttcatttccctgttgaataactaaatggaagatcctttctgtttttgaaaattatacctctctctctctctctgtctctctctctgtctctctctctctctgtgtgtgtgcgtgtgtgtctgtctgtgtgtgtgtgcttaagtgcgccacagtgtgcttgtggagatcagggagtgacttgtaggagtttgtctctcctttctgggggccaaactaagatcatcaagcttggcagcaagcacctttatccagtgagtcctcttgttggcccatttgtgtgtgtgtgtggtttgttgttgttgtttgagacagggtctcactatggagctctggctgtcctggaactatgtataccaggctggtcttgaacttacaagagatctgcctgtttctacgtcccaagctctaggattaaaggcatgaaccaccactgcctcctggtttactttattctgggggctctctctggtttgcaaatggttgctttctctgtatactcacaagtgggttcctctgtgttcacacacatttcatgactatcttcagttatttgttgtgttatagaagtagaggtggcaagaaagagggtatgcataggtttgatcagctttggggctgagttagaggtattgacatgtgtgcagctgtgtgggccagggctggcattatgcagtactctgcctgcagaagtcagccttggctgcatggattattgggcttggatccttctgtaccttgtggatgtttgaaggcacaggtgcagggttgcactggctctctggaccaaagcacccatggaggcagcagctaggctagcagtatctataagggtaagtgatttaggcatctagaaaatgagcccataggataggattgatcctgtggcagcaaaattatggcagaaataatagcttaagtggatttggggagagagataaaagaggaagttacaaagcatcattgggatagaggaatcactgcagctgctttggggcttgctaatcacaggaacagcaggtcactggctctgggtgactcctgtacttagaaacaaagacagaagagacttgacccaaagtgcagctgtggtggcagttgatagcttccgtgatagtagctgcaggcacaaggatctcaaagtctgtccacatgttttctattgctttcagtttcagtgatttctcttttctcttttccttccttccttccaaactggggatcgaacccagggccttgggtttggtaggcaagagctctaccactgggctacagcctcagcacaaagtataaggggtttgtctctctctttttgttcccagtgatttcttaaattttccttttcagtcttttctttctgctgtttgctttaggtttaatttccttaccctctccaggttgttatgatggacctttaatttgttcccctcaaatcttccttcttttgttgtatagacatttaatcctataattatctcttcaaaattcagctccagcacactgctgatgtgctgtaccttttattttcggttagttaaaacatgttaatttctcttgagacttgtgtgacccataggttatttaaaactatgttgtagagtttctaaatacttccaaattaccgactctctctttatgatttagattatgtttttggagtatgaacatagatttcacataatttctgctgctttctcaaattttattaagatatattttagagcccacatatgacacatcttagtaaatgttctctttgtgcctttcaaagcacgtgtattttgctgtggttggactcagtggttcttcaatggtaattttattatgttgattaagactactatctaatcccagcactcgggaggcagaggcaggcggatttctgagttcgaggccagcctggtctacaaagtgagtcccaggacagccagggctatacagagaaactctgtctccaaaaaccaaaaaccaaaaaaaaaaaaaaaaaaaaaaagactactatctatccaggtgttgtggagcacacctttaatcactttaagcacttcggagggagaggcaagtggatttctgtgaattcgaagccaacctggtcttcagagggagttccaagacagccaaggctactcacagaaaccttgtccagaacacacacacagagacagagagagacagagacagaagagagagagagagagagagagagagagagagaactctctttgttaccgacaggaatgtgttctctctagactacaaaactggctttgtttccttttcatttccagcagtttatcttctttggagattctttaagattccttagttattttgtaatgctattcttcatctctgataatctttgttttattttttgcctggccccgaggatgaagcccagggccttattcatgctagtcaggtgagtgctttgtactgtgcacacctcctgctctagtctgctttctattgttgcgatgaaacactgactgtcttagtcaaggcttcgcgataaaacactgtgaccaaaaagcaagttggggaggacagggtttattcagcttacacttccacattgctgttcatcaacaaaggaagtcaggacaggaactcccacagggcaggaacttggaggcaggagctgattcagaggcctggcggggcagggcgggtgggggggtgttggggtgtgtgtgtgtactgcttattaacttgttcaccaaagcttgctcaatctgctttcttttagaacccagcccagggatggcaccacccacaatgaactgagccttcctccatcaatcactaatttaataaaatgccttacagctggatcttatggaggcattttctcaatttaggttccctcctttcagatgcttctagtttgtgtgtcaaactgacacaacactagccagcacactgaccaaaaccaacttggggaggacaaggtttatttggcttacagattgcagtctatcatcaacagaagccagggtaggaaactggaggcaggaactgaaacagagagtaaggaagaatgctgcttggtggccaggcctcccctggcttgatacacagcccaggcccacctgcccaaggatgatactgtccacagtggactgagtcctcctggcaataagcaattaaggaaatgcttccagtggttccctcagtctctgctccatctttatcctgagcatcttgtaggcaggacaaattttgggtcgaaggttttgtgggtgggttggtgtccttattgctccactgggagttccgcctggctacaggaggtggccttttctggttccatatccccacttctgagagtttcagctaaggtaatcctcattgattcctcagagcctccctcatcccagatttctggcatgtccttgggatgtctatcctcccttgcctgcagatttccattcaatttcatgaccatcttagctatctctcctgtctctccccacaccacaacaccccctctattcccctcagtcccctactgcattcagttccctccttccatttgcctcttatgactgttttattcctccttctgagattcaagctttctcacttgggccttccttctttttttttttttttttttttttttttttttggntttttcgagacagggtttctctgtatagccctggctgtcctcaaagtcagaaatccgcctgcctctgcctcctgagtgctgggattaaaggtgtgtgccgccacgcccggcttgggccttccttcttgtttagcttctttgggtctgtaaattatagcatgggtatcctgaacattacagctaacatccacttatcagtgaatacataacatgcatgtccttttgggtatgagttccctcactcaggatattatttttctagttccttccatttgcctgcaaaactcttgatgtccttggttttaaaagctgagtagtgcaaatgtagtacattttctgtatccattcctctgttgaggggcatctgggttctttccagcttctggctactacaaataaggttgctatgaacatagctgagcatgtgtccttgtggtatagcaggtatacatccaggactgatatagctgggacttggggttgaactactcccagttttctgagaaactatcaaactgatttccaaaatggttgtacaagtttgaactcctaccagcaatgtggctaaagtttctttttttttttttagtataaaatagtttttatttagggcatgggggaggggagttaagagagtaacagaggcagagaaaggcagagagaaggagagagtagagaaggagaggccagccatgaccacgtggagggggaagggaatgggggagagaaggggagaaagggggcaagaggcaagggagagaagcaggagtaagagcctaaagtttcatttttagttgaaaaaaaggccacatactttttttttttttttttttggtttttcgagacagggtttctctgtgtaccctggctgtcctggaactcactctgtagaccaggctggcctcgaactcagaaatctgcctgcttctacctcccaagtgctgggattaaaggcgtgtgccaccactgcccagccctaatattctttctaattagtggtttacactgtgaattctctgtgatactttctcccttctgttatgaactggccttcgttggtgattccacagtgtgaaaatacttttgctaggtgatggtggcttgagcctttaatccctgcactcaggagacagaggcagtggggtctttgagttcaaagttccaaggcagccagaggtacacagcaaaaccctatctcaacaaacaaaacaaagcaagcaatcacagtaactttttttttttcagtttttcaagagagagtttctctgtgtaatcctggtttctttctggtatcaaaaatatgacttaaatactaatttattatcttcattttctaaaggctgggatcttaatgagcttatttttattcaacatgcattttgtaagatttacttggcatcatgactgactaaacataaataggtgatttttaaaagacattattcaaaaaaaaaaaaaaaagccgagcgtagtggtgcacgcctttaattccagcactcaggaggcagaggcaggcagatttctgagttcaaggtctacagagtgagttccaggacagccagggctatacagagaaaccttgtctcaaaaaaccaaaaaaaaaaaatcaatcaatcaatcaaaagacattattcaatctttgaagagcttattgtttagaaagattgaaaccatagccaagcagtggtggcacatgcttttaaccccagcattccggaggcagaggcaggtggatctctgtgagttcaagaccagacatgtcttcagagaaagttacaaggcaaccaggactacagagagaaaccctgtcttgaataaacaaaagacaaacaaacaaaaaaaagtagctgtgattgtttgttgcatacaaatgggaacacgagaaaacagatatattaaggaataagtaaagactttatacacacacacacacacacacacacacacacacacacacactggagatatggtcttactttggagccctgactggcctggaagtatgcatatatgtatattaggctagcatccaacgcatagaaatctgtctggatttgcctcctgagtgctaaagttaaaggtacacatcactaaacttagcctagagtatatatttaatacagctaagtttattggctcagaatttgacctttgaggagcaccagagtttagtgagaattaataaaaggacctttaaagtaaatattttagttgctttatatgaaaaaaaaggcaaacccctcaagatcacatttttttgtggaataataaaagcaacatttattatttttataaaagtatgaacatgaatatagtgatatttatcttaaattctccaaaatcacctatttttcttgtgatccacacataatttatctaaataaattggattgtgttttattagtgtttgttttgttttttgctttttcagtacagggtttctctgtgtagccttggctgtcctagaacttgctctatagaccacaggggcttccaactaagagagattgaccagcccctaccacctgggattaaaggaagattagccactgcattaactaccaccacattaaccaccacaatatttgagccaaatttgaagaaagctttaattaaataccagtcaggatttgaagcttaactttaattaaataccagcctggaggatggactctggccagatcaattcctgggttcccagaaagtgaccaggagttacatcttgcaaaggcttaaaaagacaaccccacaaggccaccatatttcccacctacacccaatcaggggcaagcatacatcctgacatacttcttgcccaaatacctgttacctacatgagatcaaacacatctgtgtagttgggtcaaacaaacttgtttaaaagagtgaaacaatagcctctagtatttcaggaagtatctgtccttgggtaagcgggtttacaggttaagaattttgtttcaaggatctcttaggcacagtaattaaaacacccatacacataaaaataaataaattaaaaatctatcaatagtgaaattgttaaatcaaaatcattaatgcagttataacgtttgtatagaaattattaaacatatttgacacattattcaagaatacagtgcctggttaactatagtcaactattttccaatagatctcttcatttgtgcatgctactgaactgaaatagtctacctttaaccaacatttcctcaccttacccttaagcacttgataaacactattctactctagttctgtgagatcagctttattagattccacatataagtgaaacatgtgtgacatctgtctttctgcggggtttattaatataatgtcctccagattcttacaactaaccaaaataatgtgatttccttcttcttcttcttcttcttcttcttcttcttcttcttcttcttcttcttcttcttcttcttctttttgtttgtttgtttgtttgtttgtttgtttgagacagggtttctctgtatagtcctggctgtcctgaagtcctggaactcactctgtagaccaggctaccttgaactcagaaatccgcctgcctctgcctcccaagtgctgggattaaaggcgtgcgccaccaccacccggcgtgatttccttcttaattatggttgaacaatattccattgcaaactctacagtcatgtctttctccctttctttctttctttctttctttctttctttctttctttctttctttctttcttccttccttccttccttccttccttccttccttccttccttccttccttccttcctttctttctttcttccttccttccttccttccttccttccttccttccttccttcctttctttctttctttctttctttctttctttctttctttctttctttctctctaagacaatgtttctatgtgctgatctggctgtcctaggcctagctctgtagaccaggctggcttcaaaatcaaagagaaccactactgcttactgggtgctggaattaaaggcatgctccacggtacccaacaaaccccattttcttttgttatgcatgcactgactgccttagtatttctgtgtttccttctagactgctttgcataaaggatgttccaatttacattcttagattatgcaaaggctttgtttcacatcctggccaatacttagcttttctcttttcttttctttttttcttctccaccccccactccccaaccgcagacaggatttctctctgtagccctggctgtcctgaaacttactctgtagaccaggctggcctagatctcagaaatcctgcttttgctgcctgccaagtaacttttgtcttttctataatcatcctagcaggcataaggaagtgtcttacagtggtttcagtttgcatttccctggtgatgagtggcttagtttcttttcctgtcactgtgataaaatattctgatgaaagaaacttaaaagaacagctttatttacttcacagttcaagacacagctcttccgggtggggaagtcaagaaggcagaagcttgaagcaggtagccatatcacagtcacagatcagaaagcagagaatgatcagcaggccaatgcttagctttcctttttcattctgtactttccaggcttccttatccaggaaattgttctgcctgaaattaagatgggtcttacaggccgggcgtggtggcgcaaagaaaaataggctacacagagaaaccctgtctcgaaaaacaaaaaacaaaacaaaacaaaataaaataaaataaaaaaagaaagaaagaaaaccaggcatggtcaggtgtttctaggttgacaaccattagtcatgctaagcatgttttcatatatctgatatagctgaatgtataataatatcattcatatatatatatatatatatatatatatatatatatgtgcaattattttctcccattctgtacattgtctcatcacacttgatttttttcaaaagtttattatgtttgatgtgaaaatcacttgttttttttccttgtccatgtttttcatgtcatagccccaaagtctttactcagactggtatcagagagtttgtctccatgtattactgcattagttactttgctatcactgttgtgatgcatcatgatgaggtaacttctggaaaacaggctttatttggtcttatatttccagaggcttagaggccctgatgtagagcggaggcagtgggccgtagacaaggcagctggagcagaagcattttccaaatcacaagcagtaagcagagaaggaaccaaacatggtgcaaatctttaaactcttaaagcccaccttcaggcacatatgtcctccatccaggccatacctcctgaaccttccaaaacagttccaccaacctgggaccagtactcaaatgctgagactgtggtatatatctctaatctcagcacttgagagacaaggatcatgaatactgccacaagtttgaggccaacctggcccacatagtgagttctaggccaggcaaagatgtaaagtaagaccatggctccaaaaataactaaataaaataaaaaatgtttactagtatattatattttttaatgcgtagatctacatatctttggttaaaattatttctaagtatgttcacaactgtaagtgagattgcttctgtgaaatctttcatcaattatttcctattagcatgtcaacttattattgacttttgcatattgattttgtgtcctgtcattttccttctcagatctaacagcttctggtcttctgaaagattataagataatgttatctggaaacaaggaaaattttaacttattttttcaacttctgtcataacaaaatatgggttaagccacaatcactatgacacaagccaagatcctattcttcatcaatgtgatgaaggaaagaaacactaaaagaacagtacagatgagtaggaaaggctggtttcttaatttattcctaaaaggaggtcaaatggatgcatgtgttcagatttcacattaaattgagcatctgggactagaactggaacatttcactacatggtattaacacattaaatgcatgtggtgatagagactaggattatgatcctttaaaaatagtgttatcgctgggcatggtgacacacgcctttaatcccagcactcaggaggcagaggtaggcagatttctgagttagaggccagcctggtctacagagtgagttccaggacagccagggctacacagagaaaccctggcttgaaaaactgaaaaaaaaaatagtgttgtcaaccagacaataaggtgctctacagtatatgtttaggttactcatcacttactatataggtagcaattttaaaacaaaaaaaggaaggcaaatgaactccaacttttttcaatttctctgttataatcaataagaaaacaaacaccagggctagtaagatggttccgcgggtaagagcactgactgctcttctgaaggttgtgagttcaaatcccagcaaccacatggtagctcacaaccaccggtaatgagatctgacaccctcttctggtgcatctgaagacagctacagtgtacttatatataataataaataaatcttaaaaaaaaagaaaagaatccagcacttgggagacagaggcaggcagatttctgagttcaaggccagcctggtctacagtgagagttccaggacagccagggctacacagagaaaccctgtctcaaaaaaaaaaaaaaaaaaaaaaaaaaaaaaaaaagaaaagaaaagaaaacaaacacaaatttggttctatgtgaacatttcaaaatatagcattgaacaagaggaccaagaccaaaaatgtgtgtcagaaattcaactgtggccgggcgtggtggcgcacgcctttgatcccagcactcgggaggcagaggcaggcggatttctgggttcgaggccagcctggtttacaaagtgagttccaggacagccagggctatacagagaaaccctgtctcaaaaaaacaaaaaaaaaaaacaaaaaaaaaaaagaaaagaaaagaaaagaaaagaaaagaaaaaagaaaaaaagaaagaaattcaactgtgggccaggcagtggtggcacacgactttaatcccagcactcgggaggcagaggcaggtgaatttctgagttcgaggccagcctggtctacagagtgagttccaggacagccagggctatacagagaaaccctgtctcaaaaaaaaaaaaaaaaacccaaaaatcaaacaacaacaacaacagaaaagaaattcaagtgtgagcattggcccctttgcacagctttctagggttaataaggagaagctgcaccagcagcaggatttcagtaattaaggaaagctcttctcatctagaggtctgtctataggccaacactgatttgtacaaatcttttttttttttgttttttttttgttttttgtttttctgcctgcctctgcctcctctgcctcctctgcctcagcctctgcctccagtgctgggattaaaggcgtgtgctaccatgcctgcttacaaatcttttagtagatgagctccatgcacaggacaggaacatgtcagaatggatgaatgatctgtatactatataatttttgtcactcgtatttatagagtgcctgaataccaagtagtaattaaattactcttctgtactttccacaacttcatttacagcatattccttatgaactgcttcccctagatttttcataattagtgtcatcttttgaatacagttcatagtccctggcagaaagacaaaggagctatttttgcctgataataaatacccaataatcaacaagcccaagtttagctcttcagaactctttaagttccactttttccaagattcttcccttgttttttgttttttctgttttttttagatttaattaatttattttatgtatatgagtacactgtagctgtacagatggttgtgagccatcatgtggttgctgggatttgaaatcaggacctctggaagaacagtcagtactcttaacctctgagccatctctctagcccccttgttttattttttaaattttattttcaacaacttcataatgcacataagatactgggatcatatctatcctctcttaatcccccctctcctatagactcctttctcttccaaactggttcctgtcttaattttctctctttctctccctccctcccttcctatttttcttcacttacctcgtccttgtttcctcctcctccatcttcttggtttttttttttttttttgagacagggtttctctgtgtagccctggctgtcctggaactcactctgtagaccaggctggccttgaactcagaaatctgcctgcctcttcttcctaagtgctgggattaaaggcgatcgccaccatgccagactaattttacttattttaaaaactctttttgctccccttccttttctctctcttgctctggtcctgcttgctccaggccctgcttgctcctcctctgccccctacactcattatgctcattatggctcataggtttttgttgttgtttgtttctcattatggatggtggtgagccaccatgtggttgctgggatttgaactcatgacctcagtcagtgctcttaaccgctgagccatctcaccagcccttaaaaacttttttttttaaatgaatgaggcaatttattaacccagcattgtttgttttaatgctttttgttggcagttgctacctgtccagcgatcctgtccagatgtctctgtccctgatgtgttagcttgcagtccccatctcggccattttcagcccctccagggcttggaggacctggctggccacactctcagagcctctgcttaagtggctgggcctaacaccatttctctgccatcctctgtagatcttggtcacagaaccaacccctgcaccaccgcggaggtacaggtgccgagctgtggaagcatttcgtgggtagaaccagttctcatcatatgggcaagctctttatgtttggccagctttactgtgtccacacattccgggactctcagtttcctggactttttgaggaaggctgctagagctctgacgatctcctgctggttaaagtcttttacagtaactccaggaatctctctgctgcctgggctctggaattgtggcgatcagccatgtccgggcctgcctctcacacgtggccccttaaaaactcttaaaataaatttgcctacatttgtctgtgcatcacacatgtgtctggtgcccatgtagaccagaaaagggcatcagatcccctgaaactttagttgtagatggttgtgatctgatatcatgtgagtgctgagaaccaaacccaggttctttttttatttttaaagattttatttattattttatgtaaatacactgtagctgtcttcacacactccagaagagggagtcagatctcgttacggatggttgctgggatttgaactctggaccttcggaagagcagtcgggtgctcttacccactgagccatctcaccagccccaaacccaggctctttgcaagaacaggcagtgcttttaactgccgagctatgtctcctggccaacgtcttatttttgtgctgggcttctgaaggtcaccatgcttacctgctgtgttcatggttaactgaccatatcatatccaggaggccatgtttcatcaaattcctccccatcctccagctcttataatgattcttcctctttttccttgatgccccttgaatctttgaaagaatgatatagccgggcgtggtggcacacacctttaatcccagcactcgggaggcagaggcaggcggatttctgagttcgaggccagcctggtctacagagtgagttccaggacagccagggctatacagaggaaccctgcgtcaaaaacaaacaaacaaccatcagggctgggtgtcatggtgcacatctttaatttcagcatttctgattggctagacagactgcccaatctgac

SEQ ID NO: 34 - skipped

SEQ ID NO: 35 - DNA, 32094 bp, Homo sapien
ggaagtcaagaatttcgcgacgttaagcgacgacgtcggtataaagaatgagagagccccgaccttcgaaggactgacttctagagagacgtgaaccccaagaaagatcttgtaaaagatcagggggttgtgggaaataccgcataaagaaatttttttagtggatttaaggtattttataaaaaaatttaagatatgaaagaggatcacagaagaactgtgcaggaggtataaaaaaatttctttcataaaccttataaaactccgttaaaaattataaattccttaaaaagaaaccttagtaaaaaccaactgtagagacaaaaaacacctagtcaaaaaatgagaaggtgagagaaaagatataaaacgggtagccccgacgcctatggaccaaaataataaaaaagaaacgggttgccccggcacctatggacggaaaattaagaaaaaataagcgggtagccccggcgcctatggacgaaaaataaaaaaaaaggaatcgggtagccccatagcctatggacgactaagggaaggggagacttgggggttgtgagaccgggtagccccactgcctatagacgaaaaatttttaaaagaaaaaaaccgggtagccccgaagcctatggacgaaaaaaaaaaaaataaaaaggaacgggtagccccggagcctatggacgaaattaaaaacaaaaagaccgggtagccccggcgcctatggacgaaactaaaaaaaaaaagtagcgggtagccacgaaaaatacctacttttttacaaccaaaacacccaacaacgtgagagaccttatagatgtgaaaaaaaacgacgactagtaaaccaccacacactcacatggatggcgaaaccgtctcttactgagacgtcaattcgattcccgcacaagtctaacacctccttttcaccggcggtaaaatctgaacggcgtattgagccgaatcccgatcagcaaacacgattcaatttgatccctccgttctacctactatcgtccagtccgtctccttcagtacacgtaacgtactcgatttggatagacttacttaactaaaccccgaacaatcctcgaaacgcactaacaacatagccctccgtcattcttagtagaaaatagtcatgttccctgatcaatttttaccttccaatcctttctgattccacgtcccgaattttaccgctaaaactgtaacgccgtaacgagtcgtaccgcccgacacgaaacaatccaacaggttttaccgcctaggtcaagacagcgtcacaagttcaccgcccttccggtgtagtactacccgctccgaaacaattcaccaatcgtaccaccacctgtacacgccagtgtgtccttttctaccgccgacttccagaacggcgtcacattttgtaccgcccggagaaacagaaacgacacacgaaaagcacaacccaaaacggcgtccctgttataccgtccgcaacagtatacatatagtaccgaaaacagtgcacctgtagtaccgcccgaacggcgtaacaatttctaccgcccaaaacggcggatcacggtgcgtctcgccctcttttccaccctacctgtcacgacctaacgacgtattgggttggttaatctttacccccaccttaactagtgtcggttaatctcgtcttctaccttaatctgactactgtgtgacaggtcgatgagtcgcttctggacccacttaatcgtaccgtgaagcgtcgacagaaatcggtcagtcctctttcttcacctccccggtgcacatacagagggtcacccgccatgtggtccacaaaagttccagaaaagttcctgtaaatcggaaaggtggagacaggggagaataaacaggggaggacaggtcacgacggagaacgtcacgacctatagaccgacacaccagacttggagggaggtaaggagacataaccacggagtggattccgattcatatggaggggggggtggggggttgggggggttgaggggtgggggtggggggtggggggtggaggggtggggggatggggggatggggggatggggggagaccagacgggacgtgacgtgacaacggtacccgtcacgaggtccggacgaaccacacctgtaccaccactcggcaccgttcctggtcttacctagtgtctactagcaaccggttgtccaccgtcttctccttaaggacggaaggagttctccttgtggatggggaaccgattacgaccccagcctaaaactaaatataaatagaaaacctacagtcagtatgtcagactaaaacaccaaacgatcacaaacttaaattcagaattcactgataatatctttacataattctccgaaataaacatcttaagtgaaattaatgtaaattactcaaaaacaaaactcaaggaattttaaggaatttcaaaaatcgaagagtaatgtttaaggaattggaaaaaaaccgtcatctatcagtttcagtttagtaaagattacaaaatttttacacgaccagtaaaagaaactttaactgaattgataaaaggaaacttctcagacatcgtgtctttgtcattttttaaattgaagtactggattacattttttctcacaaacttccaaatgtgtccaggtccggaacgaaacaagggtaggaactacgacgtgattaactgattagtggatgaatagtctgtcctttgaacttaacgacaccagaccacaggagataagtctgaataatataacctcataaagttaaaaagcaacataggacggacggatcgtaggtcaaggaggggtcgggacgagggtcgtttggggatcagatcggggtcgggatgagggtggggcggggtcgggacggggtcggggtcaggggattggggggtcgggatcggggtcagggtcaggatcaaggagtcagggcgggtcgaagagagctttcagtgagattaaaagtaactaagtcacgagttttattcaacaggtaacgaataggataatatgaccctataaggcaaatgggaaccgtaacgactagaagtcatgactgaggaactggtaaaagtcaattacgtatgttagggtaaacagacactagagtcctgtttcttaaaggaatgagccatgcaacttcaatcccttacagttaactctcgaaagatagtctcgtaataacgggtgttaaactcaatgaatagtaaaagagctaggggacgggaatttcctctttggtaaagagacagtaacgaagacatcagtgtcagggttaaaactcatcactagaaaagaacacatgacacaaccggtggattttgagaaacgtaactcattttaagattaacggttattaggatgggtaacctaatctgtcgtgagacttggggtaaacgtaagtcgtcccccagcgtctgttgggcagaaaacaacctgtcaattttacgagtcagggttaacagtatcgaaacggataatttgtttccgtgggatgacgcgaaaaacgacacgaagacctcttaggacgacaagaacctgttaatttcttgtttcatcattaacgattaacagagtgggtaattagtacttctgatggtcagcgggaacgtaaacggaactccgtcgcgactgatggactctaaattctcaaagaatttaataactcattttagggttaataggtatcaagacaatcaatgtgataccggaaacgtttgtagaaacgtattgtcgtcaccctgactgagtaagaatctcggggaagggaaccttataattacctatgttatcattaataagtaccaagacgcattgtctcttctgggtgaatacacatacggaaatagtaacgaggatctatcacacttgatggatggtggaacgtaattatacattttgtgattaacgggtatcagggtgagtaatcagatcctacaggagaaacggtaacgacgactcaagactgatgggttcaaaggaagagaatttgtcaactatacgtattaacgtatataagtaccaagacacgttatttttacctaagagtggggtagggtggaagacaccctacaacgattgctcacgtctaataagttattgtcgagaacttgtcaattaaacgtgtcaacgttaacaggtctcaggacaggtaatctttccctgagacataggataaacgtgcgatgttacacccgactagtgggttcctgagaagaacacgtaactacaagtattaacataaacaggtgctagaacacgtgattgggaaggtgagggaaacataaggtcgtcccctgggaatgatgagttctggagacatgatcctgtcaaatacacgtgttaggattaactaatcttgactcagaaaatatagttccagggacgtagtagaaacgaaatgtagttctcccacgaccaatggattacggggaggaggtctttaataactacacgttttacgttaaagggatagacgacaatcagaccccagagtaggggagtataaggaaaacagaatgtcgtcccccatgaaccctgacaattacgcgtattaacgttaataccagaaaaggtaatttaattctagggttgacgagtgtgggagaatcgtaatgtcatctcccacgattagtgttcctgtaaagaaaacatgacaattacacgatgaacgtaaacagggagaaggacacgtgatttctggggtgagtgaagggatcacaagtcgtcacctactggagatcagttctggaaacgtgatcctatcaattacacttggtaccgttgactagtgttgttacagaaagtctagtctaggtaaaataggaggaacaaaatgtcgttccctataattaatggatacaatggaaagggaccctgatacttacacgttttaaggttacaagtaccagagagggaaatttggatataagatggggaaaatgtaatatctttccctacgacctttgggtctcaggaagagaaccctgagaattacacataaagattaataggtactgagaattacacgtataaaagttaacggattaactaaagttaacagattctgtaaagtttacagattaactaatcttgactcagaaaatatagttcgattatagatcgaaaatatagttcgattatagaactgaagagtcgtagtatcttcccccatgactaaaggatttcagaaagaacttaaagataatacgttttaacgggactccggcccacaccaccgagtgtggacattagggtcgtgaaaccctccgactccacccttctagggaatgacggtcctcaaactctggtcggaccggttgtaattttttttttttttcattctgttaacgggaccttagggtagggggagtgtggaggaaccgtttcgtcgtcctcacgattgatcgatcacgaagaagagaatatgacgaatttacgcgtattaatcgtcatcaactacacggggatacaatctcatcttagggcgaaggaacgaggtaaacgtaatgacgtcctcgaagattgatcggacttaagtgagagaacctgacaattacacgtatgaatataaacgacgacatgaaaaaatggtacattcctggggtgggtgacataaatgtagggtcgaccttcatggatgatgaattctgggaatctgatcatttcaatcgcacgtattagaatccacaatatatgtgtaaaagtcaacgtatgtcaacacggaaaatagtcctgaggacatgaatagtttcgtctctcacgattagttataattcgggaagagaagcttgacatctaccgtacattaacgtcaacagttaccaggaagttaatctgaacccaaagactggatagtgtgggagaaacgaaataacgtaccccatgataagtgaattccggggaaagagtttgacaattacacggattactgttaatgtagtcataggaaggaaaacttcctgtcgtaccaaccactgtggattccggggtaaagaaccggagggttatacacactaacataaacagctccaacgatacgtgatctcttcctttcacgaggggagtaggggtgaaaagggaaggtcgtccttcacgggtggggtattctgggaaaataaacctctcagatccacgtgttaacattcactggtgttcgtacgtagaacctgtaaatacacgcattagcgtgtgacgagtaaggtacacttattccaggatgagaggctggggaaaacgttatgtcttcccaacgactattgcgtcaggggaaaagaaccgtacaacacacactaatattagcagaccctaggatacgtgatcttttcctcccaggagaggtgtatggagtcagagtggaaagggaaggtcgtccctcacgggtgaggtattctgagagtgtaaacctgtcagttccacgcattaacaattcacttgtgttggtacgtggaatctgtacctaaacgtattgatgtgtgtcgagttggatagacttattttaggatgagagtctggggaaaacgtcatgtcgtccccacgactagtggttccgggaaaaaggaccggaccatacgcacactaatacaaacagggccaaggacacataatctgtaccttcggaggggacggtgtgaggtgggggttagaaggaaagggaaggccgtccctcacgggagaggtattctgcgaatgcaaacctgttagttccacgtgtcaacattcactggtgtccgtatgtggaacctgtaattacacgtattggtgaaacgggtaaggtagacttattccaggatgagagtctggggaaaacgtcatgtcgtccccacgactagtggttccggggaaaagaaccggacaatacacgcactaatataaacagacccaaggacacataatctgttccttcggaaggggggcgggggtgggggtgagggtcagaaggaaagggaaggtcgtccctcacgggggaggtattctagtaatgtaaacctgttagttccacgtgttaatattcactggtgtcggtacgtggaacctgtaataacctgtaattacacgcattgacgtgtaccgggtagggtagacttattccaggatgagagtctacgggaaacgtcatgtcgtccccatgacttagtggttccgggaaaaagaaccggacaatacacacactaatataaatagggtcaaagacacattatctgtactttcggaggggacggtgtggggtggaggttagaaggaaagggaaggtggtccctcacaggtgaggtatatgggaatgtaaacctgttagttccacgtgttaacattcactcgtatccgtgagtggaacctgtacttacacgtattgacgtgtaccgggtagggtagacttattccaggatgagagtctgggaaaaacgtcatgtcgtccccacgactagtggttccggggaaaaggaccggacaatacacacactaatataaacaaggtcaaggacacattatctgtaccttcggaggggacggtgtgaggtgggggttagaaggaaagggaagaccgtccttcatgggcgaggtattctgggaatgtaaacctgtcagttccacgtgttaacatacactggtgttggtacgtggaacctgtatttacacacattgacgtgtaccgggtagggtagacttattccaggatgagagtctggggaaaacgtcatgtcatccacacgactattggttccggggagaaggaccggacaattgcatacactaatataaacagacccaaggtcacatattctgtaccttcggaggggacggggtggggtgggagttagaaggaaagggaagaccgtccctcacggtcgaggtattcttggaatgtaaacctgtcagttccacgtgttaagattcactggcgtcggtacgtggaaccagttattacacacattgacgtgtgccggatagagtagacttattccggaatgagagtctggggaaaacgtcatgtcgtccccacgactattggttccgggtaaaaggaccggacaatacacacactaatataaacaggtccaaagacacatgatctgttccttcggaggagacggggtagggtagatgcgtattagaaagaaaaggagggtcgtccctcacgagtgaggtattctgggaatgtaaacctgttagttccacgtgttaacattcactggtgttggtacgtagaacctttaaatacacgtattgacgtgtaccgaataggataaacttatttcaggatgagagtctgggggaaacgtcatatcgaccccacgactagtgactccggagaaacgaaccgaacagatataagaacacatgatctattcccgtggaagagtacctgagggaaacgaaaagttgttcctcatgggtgatgaaaaattctaagaatataaacaggtttcatgtaccaaaattaactggtgttgttacagggaacctgtaattacatacattagtggtgtaccaagtaggattaatttgtttcaagatggaagagtgggaggtaaacgtcatatggtcccaacgactgggggattcaggggaaaagaaccgaacaactgtacgtattaacgtaaatacaaccaagaacacgggatctgttcctacggggtggagaaaagttatcacccacgggtgaggaatactagaaatgtaaacttgtcaattacacttattaacgtcaacaggtgttgggatagtgaagatcctggtaatatggagaaaacgtaatgacaccccatatgacaaagggaggttccggggaagaccacctgatagttgtatattaactttaaaagaaaacagaaacagtcatctaattccagtatggggtagtggaaaggaaacatcatgttgtcccacaggactagttggtttcaggacaacaaaacctgacaattatacacgttaatgtaaacgaggactagacacgtgatctattcctaggatggatgaaagaatcacaaaaatcgtccatcacgggtgatgagttctgacagtgaaccttacaagtacacgtgtttgagttaagagattcgtacaaggacatggtggaaacgaaatctcgtccccctactataagtgattcacggggaagaaaacctgaattatacgtaattacgttaacaggtggagaagaaaatctgattctcaactagaggtgtataaggggaacgtagtccccgtacaattaatacttacttgggaaaagaaaattataattacagtattaacataaacacctggacacatcctctttttctgggatacaaggagggtaatgggaaacctaacgacgactcttcacaattgatgagtattagagtcgagaacctgttaattatcgtaattattgttaatagttcccgtgactagtaatctattctgaggacgaaggagcaacgaatgtagcccccatgactgggtgattccggggaacatgacaattacacttataaacgttaatatatacagaggaagaccatctcaccctataatacgggatcataggggaaacgtaatgacgtccccgacgactgatgagttttgaagaggaccctgacaattatccgtgttaccgtcaatagttaccaaaagagggagggactggaacaattcgttcgcggggtggggtgggaatcaaagggtaccgtattatttcatattcgtaacctcataaggtacgtgaacagatagtttgtcaccaggtatgagggttgggaaaacgtaacgcggtcacacattttagtgtccatcggtaccacagtacgaaatatatgcttcagaagggagagagacggggaacacacgggaaccggggaaaaatgtctgataacgagtgttagagtccacaggtataaacgtcgataatccattctaacacgacagagggagaagggaagggagacgggacggggaaaacggagaaacgacccattacaactggtctgttccgggaaagagaacctgaatttgttaagagtcaacgtgaaaggaaccagggtgggtaatatgtacttggggagatgaaggaaagcgtaacgaagactcatacgactgatgggtttcggggaagacacaataattatttgtgtcatgactaacagggtaaaaagtcgggtagtcaggttctagagggatggtgaaaccacacaaccacgtcacaactgatacttttcgtccggacttgatccacctattcggaagtgagtaaaagaaagtaaataattactaggatcaaagttaataacagtctaagacccctgttcttggtaagaacgggtggacacaatgacgaaatgacacgttttatgacttccgttcagtctgggtccctcgacctaacggtaggaaataaaacacaaaggtcacatgtgatattttaacagaggggtccttccttccaaccgtgaaagagacgtaagaagaaaggtctcgtctaacggaccaattcttagagaacaacaggggaaacatataacaataacatttcacggtttacggtcctatgtcggtctttttaacgaataataataatttttttaaaaaaattctttctgtagacctaacatcccacctgagctattggaccagtaataaaaaaacttcggttttataggtaaatatgatacatggaccactggtcacagagagtaaaattgactcccaccacccagacacctatcttgtgactgagaacgataaaattatagtttctataagatctcaccttgagaattctggtcatagaaacacacccgaaatggtcgtaagtgaaaatctttttgatggatttaaaatattaggaaattaaagaagtagacctcgtggacggggatgaataaagttcttctaacgtcattttgctaatttactcccttgtatacgtctccacgaaaatttttcgtatacggtggaaaaaataattaataatatattttacttcgtaaattaatatcattattaaacttcatcaaacttcatggtgtgactccactcctgaatttttactattctgctcaagggataaaatattctttttattcggttttaatttataagaaaacctatatttaaagttgtcactctatcgacggatcacctttacttattatagggtcggtgatcacatgtcccacaaaacaccgtgtcctaatacattataccttgacgagttcgtttattgatcagtagtgttgtcgtcaagaaacattattgactttttcttataacaaagagcctcttcctacagttttctagccgggtcgagtccctcgtcaaacgggatgatcgaggagcctgtcgacatttcttctcagagaccgagaaatcttatgacattcatgatgaagcatcgataattcattagaaaaaggataagataaaagaaagagaatctacggtggatatcttttcagtctcccaggtcattcaaagaaaggaagaagggtggagtagacgttatatatatatatctctctctttatctatgtatgtatgtacgtatttatgtgtatacactcaattggtcgtcttgacatcttaattataacacctgggtcgagatacgatccaatgtgactattggacccatccttactatagtaggatatattaaagtaaggactctactaaaatagcaactcctcgattacactcgtgtaaactttattgaaatcttttattattcacgacaaaacacacttagtattcatcatcaaaatccttcccttgggtgttcctaaacttcaactatcttatttgaattccttcacccaaacgaaaaagagaaattcggttctatcctaattataacgtcggtagacctatcaggtcaaccaaataaaattaaagtaaacaaaaaatggagaaaacctcggtacctttctctactttccctatctcgtatcggtaacacaaaccgataaacgcttccaaccgtttaatcactaacgatttagagtattcgaactcataaaatttcaagtctctaactcccgtatttagattatgaagccgaggaaggtgttaaaatgatgtaaagacgggttcttgtctactggtacctattacgtatagcatctatgaaaaattcaaaccttggaaaaacggttctcccatcacctcttcacttcagttttggaactggaaggaacggatgaaatacgacatcaaatatatggaagaaaggagggtggaaagcatttcgattttcttcgaatcggaggaattacaaaaggtcgactgttttataacaaattgtattgtaagctttgaaaaaaagaccacgtgtaagtacgtagtgtcgtcctcgttgttcttggtatattcacttgaccgaagtgaatatcgggcaaaattaagtataggtataaaggagtcccgaacaaaggtacggagggtcggggtgaggtatacgaattgttgtaacagaccgactgactcccaatatatgtagtaccagaacttggaagaacctttgtaccagacacggtaacaaagagtttgggttcattacgaagtactactttgtggaagatttccttgttttaaaagactctaggatttttttacacaaaactccttgtgactgaattgtttctataaactttacatttatacaaaaggttaaagtgcaacagaaacagtttctacacaaaatatattgaatacatcttgaacccctaggtaatcttatataagtgtttaggggtcccaatagtggggttaaactctttgggaccagatacgaatactttagaagataaccattaatttaacagtaagtaacagttgtatgttaatattaataataaccttaaacaaaatttacttacttaaacctccactaagacatggaattcagttctccttcctaccgaactaaaatccacctaactaatatgatctatcgtaggtttccacttagaacttcgacataaatttaagtaacgaactttattaaaggtgggaattctttttagagatcgttaacatttttccctacgagacctttacacccgtagaagttttatctctattaagaacacaatcaagttgtttataataacatggtccacgaccttatttatcgttttggtttctgtcctaaatatagttccttaaacgaaagaatacctcctacgtcttcctttagtaataccaaaacccgtctttacgaatctgaaatcaggaccgagactcaaaccaagtctagtggtagttagactggtagagctctgacgatcactttattctatccccgaatatagtttatggatttagggacttttactgtaaaacactaaaccttttaaaagttttcagattacttcctttgaaaaaaccgtaaagaaatttactaataacagtaaagaaaagactgaaaagggaaatattttggaattgtacatcctaacctccttcaaaagactggtaaaagagtataggagaaagtcgaaatagaaagacattgaaggtaaagagatcggtggagggatttaatgtcttctgacactctgggtcccgacgacactaatccgtaagtattaaagaaaagtcccacaaacacgggactaatagtttacatgtcgaacttccctcaagtacagaatttcattacttaattctcaactggaaacaactgacgattttataagaatatacactttcgtaggacctttttatgcaatggtcgaatttctctttctttgattactaatatagacttgactcgattacggagaagagaagggggtttggaatagtcaaacctaccgtttctcattactacacagtcaatttgtctcgattacggaaggagacggaacagaatttctgacctaaccctcttttaactataagagtgatggtataaaacccgacatccgttcatcgtaaaatgtgtccaaaggaagtttttaggttgagttcaacctcgagtacataaattctgtatcgaccggacgacttaaattgttcaatttgaagtcaccggtacatgtcaatatatagtgatatatatacacataatccgacagctcaaccagtacaaaaacaaccactgaatccgaaatgaactatcgagaaggaactggaaaggtttaactcatgactatgtacctcgaacccgaagaagacgtagaatatgtttactcaaaccatttcttcggagaggaaatgacaaaactacaaatataatctttattgaaaactaataaaaaaaagtacaatcctactctttgactttgttttacatttaaactggccacgatctgaagaatttaatacccatctgaatttcataataaaaggaattggttaatcttacgatcagaagatcacaagggcctttgtactctccaatacgtcatctgggttcgttatgggagaataatgtattagttcacgcatattcttaaatttttatccctatactgaccttgtagtgacatgaaatggtccagggtaatattttaatagatacaatgaaatgggtatcgaaacttttgatcaccgtatcatataaaatatcatacgacaatcacactaaccgtaacttgtcactaccctatattagtgagatgttagatatacaataatttcaaaaggtcggaatatctagagggaactgacttttaatcgatgattgaatgctgaataaaaaatgtcgtctaactgatccagaaaggtcctttagacaactacatgtttttgtttcaaattaacgattacaaaaaaattttttattgaaaaactataatgcctatggaccaataaacccggaacatataaaattgtagttttaatggataatatttaggtatatttgtcttttctttctctcattcagaaatctagtctagacgtttgttactaccatgcatgacatctttttagaccttgtatctgaatggtcaagaatccaaggtaaaacgaacgaaaaatttttgacacagaatattcagaagtcgttgaccaaccctctaaaaatcttttttattggaaaattacaatcttgtcacatctctaaatgtcttactaagacttctatctcaaagacacatgaagtgtgggtcaaaaagggtcacaattgtaaaatgtaatcaaaccatgtaaacagtgttgtttggttataactatgtaataataattgatctcaggtataaaataagtctaaaggaatcaaaaaggaattacaagaaaaacacaaggtcctagggtaacttctatggtgcgacgtacacaggaatcatcagtacagaggaatccgaggagaaccattactgtcaaagagtctgagaaacaaaaactacttgaagtgtcaaaactcctgattaccaggtcataagatatcttacagagagataaccttaaacagactacaagaagagtactgatctaacccaaatactcacaaatcctccttctggtgtttccatctcacggtaagaatagtgaatagttctcatgtatgatagttgtactgaatagtgacaaatacaataggaattagtggacagactccatgataaacagtccaaagaggtcgcattttaatcagaaataaagaggtaaagggatgatatgacaagtgtatccttcagtgatacacgtcggtcgtgaattccttaccctttaatggaaggtggagtaactcccgtctcataaatgtatttaataaaccttaagaaaacgtgtcctacagaaaagaggtgttacataacacaaataagtcagtaaatatagtcatactagagtccctataaaatatgagacccaatattatgtcataatgaaataagacaacaagtttaacaaggtcgaaaccggtaaccctccagaaagtaaaccgaaactatattggggtacttacacccaaaaaacaaactcgtgaaagaataaaaaccttgatgttgtacgaagtctgagtaaacgtatagaggacggacctggattttactacataaagacgttcctcggaactatgaaaaataacctctcattataatctttagttcttcacttacgatccacgcgagtaatgatgacctcacagtaaggaagttctggaaaagtcaactgttctcgttcctctatatataaacgtaagattgcacacatatacgtgtatcgatatttatatatattggtagacatagatataatttgatttacacaaatatggatgcagaggttgagattagtaacggtgtacctagtaatatcagagtggaggaacgaatagacaatggagggtaaagatgtcactctttggaccgaaccaaccctttaaaaagacaattataatgccatcactcacaaactgtaaacgaagataccaattcaaatccctctcaaatcgacatcccataagaactttgatctttactgggaagacgggatttacaaagacggtcaaaactttgcattttatccaacgtctttgtttgaaatagaattcttggtcttaaatgaagttaggtgtaaaactgtaactaaaagtctaatttaataagactatagcggtccattcgacaaggaacccatacgtaaagaagaaaggcaaaaaaagattctcgatttcctgggactcttgtgacctccaccctttccttccctttccgtacaagtgtgcaccctatcctttccaagtaaatgactggaggtcgatcggaaggtttcacggataaattctgggttcctcatctacagaaggaaccgttaacattgggtttatattaaaaattggaaagttaaaatcagttctttcaaccacacgacaatgtttttcacgggactaattgtcgtaacagtacacgtaacgtataattagtcgttaaattttattgtactttaatacaactcatattaaaattataaaatataatctataatcaaactctgtcacaaagagttcagacatattattcaaactatcatccctccaaaagagagttcttttcttaataagtcacacgtggatgtattagtgacgaatctaagatgttaattataaaacgatataaactaatttgcaaaagacattttctttttataataatacatgataaatccaaatacccttattaacaattcaatttcacatacttgtttggaccttactttagacaaacggatgtagatattatgttgatattttgtatcgtctacatgtttaatcatcaattatctattgattttacgtttataccgtgatgataatatcataatatcaaagaaaactcaccgcacagacattatagtgtacgacacaactacgtgaagtggtttgacgacaaaagtttgacgaaatttaggacggtaatatcgtgtatcgttacgataaagtgaaagtaaaccgtgttttgtgtaaatatataacaaacgaagagaagaaaagacattaggggtccgttgttttgatcttgtaaacggtgattagaccgttgcaccaggatataatacttcatcagtatatcgactagatttgataggaatgtcactttactctcataacactttcaaaacatctttcgaggggtatacaggactcttagatacgtgtctggggtgtcaattttctggaaacttaacacccttctgtacccaaattcatagtgaaccaatggaagataaacacattgtaactccatcaaagtagaagacccaagggtcaaaggaatctcttacttttacaacttaatacactaaaaaaaaaaaaaaactctgcctcaaaacgagaaagcgggtccgacctcacttcatcgtgctagagctgagtgacgttggaggaagggggtactagttcgttaagaggacggagtcggagggttcatcgaccctaatgtccgtgggcggggggtggggggcgggggtcgattacaaacataaaaatcatgtctacctcaaaacggcacaaccggtccgaccagagcttgaagactggagtccactaggtgagcggaaccggagggtttcacgatcctaatgtccgtactcggtgacgcggaccggatacactaataattatagtgcagatcgacactgttaagacagactacgacctcataaacttggtctaccgaccgacacggtgagtcaataagagaggtattctgaaactataaaacaaccagacgttctactgcctaagagttttaagaacagtcacttataacttgggatcactttacataccaagacatagtcaaggttttacattggtgaaagagatcggaatctaagggtcaaggttttacattggtaaaagagatcggaatctaagggcaattccctttcccttacgagaaactcatacagtagtggtatcattgtccgttttgatctcccgaaactacgatttcgttctatgaggtatttatacgaattcttctgaacccctctgaccttatcaacaagggaaaatctacggtcacatatttacttaaactcgatcctaggcaaataaattttaaagaaatccacataaacgaacgtatacctcacgtgtaaatgagagtaattacctcaaaatccttcgtcatctcatttacgtatttgtacatacttggcggtacaaattgaccttcggacgtaaaccttcagttcatagattagaatctaatttaatcctaccccttcctacaaccgttctctaaaacttcgaacaagacgaatataactcttgtagtatcttgtcaaaccggaaaaatttcgatctcttatcacaacttattcactacaaggtatataaggacaaactgtaactgtatttccaaaggagtactatgtcattagggactagtccctagaccttcggacataagtaaattccatgagtccaaattgtatgacccacgaaaagtgtggtatgatatgtcatggtacgtttcacgaaagttctgacgtttaaaccgaatctaggggaaatcactcgaggatacgatatcatttccatctatcggttaataatttttgtcagttctgttaacgtggagattcgtcatcatcgtcaacggtgtggtggaacttagaacttcataaaagtcgttgtcctactggtaatcggtgtttaaatcacagtcgggaattccagccataaccaaactgggtataaaagtacatcaagaaaaagaagtgaacagattagaagggcacatgacggtcccgaacagtaatctcctgaaatccctctggttcgtccgatctttcatctctgtcctctatggatacagattacgaagtcaaatatgaaggatccaaaaaaagtaaccccaaaaacattgagaaaaccataggatggccacgaaaccatcggatgacttgggacagaaagaagaattcctgtaagactcgtacactctggactcctgacgtttgtcgatattctccgaggtttaattagtatagaaagggaaactcttagaccggttcgaggtcgattagatgaacctacccaacggtcgatagacctctttttccatcaaaccccttaaataacaacatcacgaagacagaaacctaacttgaagggtgttgagaggaaaaatttcgtcttgtgtcgacccgtaccaccgaggacgaacattaaggtcccgaaaccctccaactccacccccctagtgaactccggtcctcaacttctgggtacagagatgttattttattttaatcaacccgtaccaccatgcacggacatcaggatggatgagacctccgactccgtcgtcctaacgaactcgggtcctcaagttccgacgtcactcggtagtaatcggtgacgtgaggtcggatccaccgtctcgccctgggtcagagaatttttctttcttttcgtcttgcactcggtcaaaagtagttaaggatatgaaaaagaaaacgtacatgtgtatgtaaaattgaaatgtattactcaagccggacaaagtaaatagggagtctcgacccgaggtcactccagacattcccgttcgtatgaactaggggttacttcttactctctacgtttcgtgatttaataaagaaaagagtggtgtgtcgttctatctaaattacttgaattgtggaaaactaatcaccggaaaatttaataagggtgaaaggaaaccgtctacccataattcaagagtcctaaacaaatgtttattctgattgaagtagacataatcgagtcaaaaccatccggattaaggtaatagtgacggtaaaggaacaaaattctttagttttaaagaatcgaactttttgttaactttaacaatttttcaccttatcctctcggggcccccggacatattccttaaatgacttagggaccaaaagacatggaacaaaaaggaagacgtatctaaacgaattgacaaaaacaccgcacataaaaaaaaaaaagcgtcaaagcgagaacaacgggtccgacctcacgttaccgcgttagagtcgagtgacgttggagacagaggacccaagttcaataagaggacggagtcggagagctcatcgactctaatgtccgtacgcgctggtgcggtccgattaaaacataaaaatcatctctgccccaaagaggtacaaccagtccgaccagagtttgaggactggagtccactaagtgggcggagctggagggtttgacgaccctaatgtccgcactcggtggtgcggaccggtcgacaacaatattgacctcaagatacacgaacactggtaagaaccaaagaggcttataggatcttgaaaccaccgcgggataatatgtccaacaacttctttacaatggtacacctaactcatcctttgttaagagaaatagaaccgttataataccgtaccgtgatgaatttcatgtttaattttctccccctacgatgtcttgatcgactgtccgtgaaactatctccacctaaagagtcaagaattttatcgagaaatatttccttcggtctccgtaacacctcctcttaagaatgtattgagtatcccaatctggtgtaggctggaaaagacacaccgaagtaccgagagaaccaactctttcgtaatcaaagaggaaggtaatcaaagttggagaactaaagaactggggggatgatataaaacacgactcttgtgttcccataattgttgggtgtaacatctcctagcgagtcattatttctgacctcttattttacgtcgtacccttataaccgttaatgagtcaagatttaaagagaacctttactccctttcgtatgtcttatctcgaccttacttatcctattaaaaaaaaaaaaaacgattcaaccatcggtcttatattgtcgaggcgtgttgacatttacaggtgagaagttaggtgtacttcttttcccatttttataccaacttgagttggtgatcaacgggtaatcttgtctgaaagggtcacatgacgtaaagttatgaaaaagaaaatagagaaaagtctagaaggagtcttcttatccgaacaacaaaatgtcacaatcactaggtaagggaaactgctagggatccacctctaccccgtactcctaggaggtccccttttcgagtgatggtgacccgttgttgggatccagtcctccaagacagttctatgaaaggaccagggtctatccttctatttcagagtttttgttggtggtgtgcagttccacgcattcgacagggattttcgtattattcatcagaattaaaactaaaacaaaaggtcatatgtaacgtgaatcacaaagtgactccagcataagtagtaataagacgtatactaaaccatttttgtcgaaggattgattggacccttcgttgacccacactctaattgaccaatttcactactacatttctcccatcgcccaacgtacacaagcccacaaacctcaccctgatatcgtgcaccgtctccgaatgtcgattcaacaagaaaatcctcttgtacctgttgacagtgtagtcactgtaactagtgtacccgtttagtaagacaaggtacaccaggggtttcagagagaatttcggaatgtcttcttgaaacggttagtaaatgtatgaagtcctaccgaaccctacggtaccacatattatgttgttcactctccacacagaaaaatacgataccaacgactaactaccttcggcgtatttatgtttacctttggactgatttttaccgtgtttcaatagacagtagtccgtcctcgatttcttggtcctgggatgtaagagatccagtcacaaccctctccgactaatcgctcactcttaaccgtctatttccactggtaagccacgttatttaggacttgcatatccgaaacgggtcgtaagaagcatttatcacccatcgatatttaaagtactttataaaagtacccattcttgagaactttacaatattaactgatctttagagacatctaaatctttatctctcaatgattgtttaacaatctttcagatccttgatctttcgattcaactctcaatagatccttctagatagataacatgagtattagaaatctatttaagaggatcccggtcatcagatacacttaaaagaaaaagaagaagaagaagaagaaaaaaaaacataaaatcgacgttacaatttgttggatacacttaaaagaataacactcttataaacggaaggtctcactgagtggaaatagagtttctcgttataacactcaaaacttttacgacgagattccgacacaaaacaatcaggactcggtcctctgaatttcgtttgaactccccagaattttgtagcttcactcggaatttgtaacccttctggaatacaaaaagggagagtatagataataaaaacactagagtcaataattagtaaatttccctgagaaaggatcgactaaccgtgaattttgtcctaccttcagaaaaaaaaaaaaaaaaaaaaactctacctcaaaacgagaacaacgggtccgacctcacgttaccacgttagagtcgagtgacgttggagacggagggcccaagttcgctaagaggacggagtcggagggttcatcgaccctaatgtcagtacgtggtggtgcgggccgattaaaacataaaaattatctctgccacaaagaggtacaaccagtccgaccagagtttgaggactggagtccactaggcgggtggagttggagggtttcacgaccctaatacccgcactcggtggcgcgggccgtcaagaccagaaattgattccatattccgatactgaccatcaccacagagatcactgagtagttcactataaaccgttctgtaaaagggtaaatacggtcaaaggataagacaacttactcctttaaaagagagatttctggattttcaaaactgaaatatccaaagtttcaagacacctttgtaaaagataacgaataattaaacttagaatacattgagatcgtgtcatgagttataaataccgtaaatgtaccaaatagagtacaaaaaaatatcgagaagtaacaaggatagacggtttagtaatatgaaggatgttcgtcacgtctctcgactcagaagtcgtccaggttctttaaacttgtgtgacttccttcagtcggaagggtggacttctagttgtacggaccgtgagatcgtgaactcctatcgacttacttcattcaacaactacaacgtcaggacactcctagtgaagtcttgacaatattgtcgacaaaaaaccctcgaccacaacctaccccacacaaccagattacacttcaccccgatttacactctacctttctactggtcagaaggtataatgactgacccaagtgacttcgttgagtttctgtaataccagaagaatggtcaacatagtgtcttcttaaatcggaaacgaacacacaagatacagaagtgacatatccgggagacagtaagaatctcggaatttgcaactcttcgaattttgtggtaaagacgaaagacgactttcccattgggaaagagtagaggcaaacactctctgagacagcagtcaattctaatcacatttttcttttgatttgagacttcatcggtaatattttcacactcttacttcagtcaaaagatttctcaacccctttccactacgatttcctcccctaactcgttcaggatagtttctcggaaaatacttttatgaatcagtagacactgtagggtaaaccgagaaggtctttaggatcatttatcaacattgtcctacaattctccgtatgtaacacacaaaatttaggagacgatgagtaatccatatactggaaactgttgaatttcagagatctgaagagacaaacactcccaatttactttagtacatacatttcacgagtggataacgtcacggaccgtgtacagttcattttccattgggttcttctgagtattcaagtaaagggtgttatattcactggtgatcgtgatagtccatcgtccgtctcaaccgtacgaaaccaagatacattctttagggattccattttcaaatatttatcttctcgtagacacaaccataaccaccaacaataataacatcatgatattcatcataagcatcattgttatcaaataatattaatgattactgtgaaaaactaaaaaaaatagaaagacactacgaaaagtacggagaacacggggagtgacatagaacggagaagatgatgaatgaaggagacttacagacggaaacgaatagagaacgtgagttcacacataaagaaacagagaaagaaagaacagaaacgagaaacaagagatagatttcacacagaatgggtaaaggtacaaagagaacgattaaagaaagcacacacggaaacggagtaaaagagaaaaacaagtgttctcaccagacacagaacagaatctgtatagagagtaaaaagtaaaacaacgataaagagaaacgagaggatctacaccgagaagaaagtgcgaaataaagtacagaggaaaaacccagtgtacgacacacgaaaaacaggaaaagaacaagacagatggagaggaaagagacggatggagagaaaagagaaacacttgacactaataaacaatggggaaggggaagagcaagcaaaatttaaagtggaaaaaagactcagaccggaggaaagacgacaaagatgaaaaatagagtgtaaagagtaaagacgtaaaggaaagacggagagaacccgataagagagagaggaggggacgcacggagtcgtagagaacgacaaacactaaaagataaagtcataattagagacaaccgaacataaacaagagacgaagaagggaaagatgagtggaaactcataaagtcggagaagtacttagatagagggagagaaactaaagtacattagagaggaatttataaagaaacgtatacacccgttcacatgcacacacacacagtacacaccgtctccccgaaggattggggacggactatccacgtcttgcagccgatagtctcgttcgtaacacctcgccaaggaatacggtccgacggtacactctactaggttctggttttgttccgggatctgacgtcattttgggtcttgagttcatcccgtcttccaccttccgagtatacctatcttccgggtttcatattctgtctaccaaactctgaactctgggctcctgattctacctttcgggtacaaggttctatctatcttcggagtccggactttggttgttttcggagttctcggttcttttgtctcccaccggacttaacctggcttccggactcaacctaccttcagagttccgaactcaatcttcagaattctggaccctgtcctgtgtaccttccggattcttgactctgaacactgtgttccggttgctggattctaatcgggtcccaacatcgaccttctggatgttgggttcctaccttccggggacagtgtttcggatggatctacctatctcctgggttcgctttttccatagagttctgattgccggccttagacctccgggtactgggtcttgggtccttcctatcttcgaacttctggacccctttagggttctactcttgggatttgggatggagaaaagataacaaatgtgaagaatgagaatctataaaggtcaagaggacaaatagaaattcggactaagaaaactctacatgaaaaactacaacggccaatggaaatctaactgtcataatacggacccggtcagaactcggtcgaaatttagtgtcgaaaatggataaacaatccgatatcacaaaacatttgaagacaaagataagtgtagaagaggtgaactctctctgtggttttaggtcagtcatagattagaccgaaaacaattgaagggagtcctcgtctgtaagtatatccactatgacataaagtcaggaaagaaaactggggtcttcgggatctgactcttctattttaccagtccaacaaccccttttttttcacggtccgagagatctctttttacacttctctacgaggtccggttactcttcttaatctgttctttatgtgtctacacggtctgaagactcttcgtggacggtcgttgtcgaaggaagaaactcgaatccactcgtcctaagaccccaaaccctaaagatcactaccaatacctttcccactgacacggaccctgtttcgctccagggttcccctgtcggacttgagggacgagtatcatcaccggtttattaaaccacctgacacggttgcgatgaggacccaaattatgggtagagatccgaatttctactctcttggaccctgacaactcgtacaaattatgaaaggaactaaaaaaagaaggacaaatacacccttcaactaaatttactgactattacacatactttcgtgacattttgtattctctttttggttaatcacataaccgttagtacgtcaattgtaaactttcacgtcacatttaacacttcgtaatacatttagtccccaggtgtcaaaaagacattccccagtttagtatttatgaaatctgacacccggtataccaaagacaatgtataaacaaaaaatttgttgcaaaaatattccagttttagtaagaatcaaaaactcggttaacctaaaccggacgacaagtatcgaatggtgggggactacataataaacaataagtctcttttaaagacttatgatgatcaaaggaaaagacacggacagggacacgatccgtgatttttacgttactaataactatagatccactggacttttttttatcacttacacgaaacatttgacatttcgtgaacataagatgacactattcgcaacacctatgtttctttcctcgttcgtattttttcacgagaaagttttcctatatcatgatacgtctgtgttccttaacaaactatttacttatttaatatacatataaactccggttaaacacaaacgacgagaccattaaaactcatttttacgtcataaggtccatagtctttgcttttgtgtacctttgacgaaaatttgaaattttatatgacttttgtattccctgattcgaacaacaccagtggatattacacggtctatggtacgacccacgatctcgatggtttcccccttttcataagagtatcttgttttttaaagtctttccacgtataatttcacgaaacatttgatttcgtactatgtttacagttacccgatgtataaatacttacttacttacctacttacttataattcacggagaatgtatggtcgataaaacccatgacattttatgttctaattaagaggatacattattctcctttcaaataggagatatgataagtctacattccttactatataacgaattaaaatttgttagttctgaaatgaccactccaattcaatttaataatgactatgtaaaaaggtccattggtcctttctcgatcatactcctttacttcattatctacactctaggtctggctttcagtgaattaagtcgaacgcttacacgaaagatttaatatttcgtgaacatttactttttaaactacgaaagacatacttattttgaaagacattcgatccataacagagatgttttaagagtaacatatcaatttggtgtcactcttcccaagatattcatcaatatgtttggttcccaaatttatggacaatttatctagttaaaactaacggatgatacacttgagtgacaatttccgtgacttttaaatagtataaagtaaatcggtgtcggtttttattccgttatggatacaatcgtaaaacacttgagattccgtggtatatttacattgacaactaaaagagtgaaccacgacccatgatccaaatattttaacatactatcaataatataacacgtttatttcatccttttaaacttattgttactaatagaaaacttatgcgtatgcgttccctaaccaacagacttcttacggtgatatcatcaatagataacacacggttagagtaacgatccgtaacccctacgtttctatttggtagaaataacacagaacccatcgtcttcttttatacacattttagttaaatattaaacatttgacggtgggtatatattcgatatagacgacttactagtaactaatgagaataggaatctctattgttgacccccgtgtttgtaaataatagtaataacttggatgttgtctctagatacacatctaaatgtttcggatgtcaagatatgtctatccttacttgataaccgaatgacttaccactaatgaaagacaccccgagccttgatgtacgggatcctatatttttactacaatagtaatatctcacgagtgtcttcctttacttcattatatccacactctaggtctggttttcagtaaattgttcaaataagtcactacttttgtaccctgtttacctgattatattccgtcacatgattcgactcatctctctatttcaggacaggtcttctatgtacgaaggaccggactaactcctctaccttttaaaaacgttttttgttccacaacaccagaaggtaggtcaaagaattcacgactactattttcacttaatctgggtggaactggaccggatgtcttcatttcctcatttttatttacggagtccgcacgaaaaactaagtaaactatttgtttcgtagaaaatacaccttatatggtaagacccaggactcctattctctctactcccgtaatctagtgactgtcgacttctatcttcttgtagaaaccaaactaacaaatttattataaagttacggataagagacgttccatgatacaaagcatttaatttatccagaccgggtcttctgggtgagttaacggaaactctaatttttttttttttttttctttctttttacgttcaaagaaagttttatttctctgtaaaaaggatcaaagtccttagggggtttagtgaaggagtaaccgaatcaaatttcggtcctctgactattttcccgagtcccaaacaagaaattaagtaattgatttgtaagacgaaaataatgtcaatttaccaagttctacattgttgatcaaaatttccataaacgagtaaccagaccgaatctctgtccttctgtatactcgttattttttttctaagaaaacgtaaatggttaaatcatttttaaataattttgacttatttcacgacaagaattcacgaactttctgcatttggtttcacgtgaaatagagtaaatagaataccacctttgtgtccttgtttaagagattctctgacacaaagaaatcaactcttctttgaagtaactcatcgacactatacaagctatgattcctttttgatttgtctagtggaaactgtacgcaacatctcacccttattctctcccgaaaaataaaaaagcaagtatgctcataactacttctactatgatttacgatttactttatatagacgaggttttccgtaaataagactgaacctctacgttgtttttgtgtttttaccttacttcactatgagaagtagtttgtcttcactgacaatagagttggtaaaacaatttaggatttgtcttttgttttttttagtactgcttttctgtgaacgaataattaaccgaacctttcatcttatatcctctttccaatgacaaataaaaaaaagtacataagtaagtaagatgtttatataagcccacggttatccatgaaccatattccaaaaaccggggtctctgtaccctttttttacgtacggaagggtctcttacggattatgaaaggaaaaccgaacaaaagaacaatccccgtaccgaatcagggatttattgtaacacaccaaattaaggatgaggcatagagaagatggtgagaccggtgatgctattcgtccatcgacccaaaacatcactcgaacgaggaattcaatgtccttgagaggaatattatctgtgaagtaaaaggatcaggtagggagtactttttactgactggtgacgacccgtcgtcctccctactactggttgattaagggtttggggtcagagtaaccatggtcggaaccccttggtggatgtgaactcggtgttaaccaaaacttcacgtaaatgttccaaacagataaaagtcaagaaatgaaaaatgtacgactgtgtatgtatgtgacggatttatctagagaaagtctttgttaggagtctattgcgtatcgttttacctctacctctgtactaaagagtacgttgtcgaagagattaatatggaatctttacaagaggaaaaatagtagtttagacgagttcttcccgaaaaatatcatcttattatagtcacctacttttgtcgaattgtaaaatggtacgaattcaaaattcttattttatttttaacctttattaaccggttttaactttcctttttaaaaaaattttaaagagatttacatccggaccgacccgaaactggaaaaggcaaaaatttagtgagtgtctcccaccctgtcctccttctcacttccttttccagtttggacaaaattcccgttggacggaaacaagacttaaccagaattcttgtaatggtcgaggtccaaatttaacaagtcaaagtacgtcaaggttatcgactagtaacaactctactcctgttttaggaaacaggagtgatcaaacgaaatgtaaaaacttttcataataaaaacaggttcacgaatagttgatttggaacacaatccattcttaccttaaataattcacttagtcacactgggaagaacagtattctaatagaatttcgacttcggttttatacgaagttttcttctcctgaaataacaagtaacatcaagtatgtaagtttcgtagacttgacatcaaagatatcgttcggttaatgtaggtattcacctcttcctttatctatttacagtttcatactaaccacctccctcgttccaacttctattagaccccaactttaaaagatcaaaagtaagacatgtaaaaatcaatctgtagtctaaactttataattacaaatggaaagttacacaccatagtcgacctgagtcattgtggggaaagaagtcgacccctaccccttacctaataaccttttacctttcttctttcattgattttcggaaggaaagtgtcaaagaccgtagtgatggtgatgactaatttgttcttattctcttgtaaaatagtagtagacgaaataagtgtatttacttcaacactacttatttagacgaaaatacgtctgtgttccttaattcaccgaagcagtaacaggaagatggagtttctattaaataaggttttcgattctatttaccttctgagaacttgaacacttgactacactttacgtcttagagaaaactcagaaacgacaaaccttctaactttttataacaagtcgtacccactggtggtctttcattagaattcggtagatctacagtgttaactttgtttgacccctcaaccaacgataacattttattttatatgacaaaac

SEQ ID NO: 36 - DNA, 60401 bp, Homo sapien
tacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgagtgttttggtgtaactgggtttctttatgtacaaagctacagaattccccttgaagacactggccttgacatccctgaaatagcaaaatagacttttttgtttactccacgtgtagtatatgacagttagtgcattgtagatagggccatctattgaaatctacatgtgattatactctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgacacacaatttacccatggaaatttacccattggcttttgctgcaaaagtaccccttgaacctaaaataaaagttggaagaaaaaaacttaacatagcaaattcttagacattgttctgacttgtttgcaagacctatgctttcttcctaagctggtgctggatagttcttttgacttttttcattattgatcttctctctccctagcattgccaccaagggaaactatttcatgtaagacattcttttccatccagccatctggttggccctaatttctctgagcacatctttcccacctgtattgtgaaccatagagcaggcctaagggaaggttataaagaaggtaaggttggtctgtattgtctcagtctcttttaatatctattcccttctgtatggtactccttcttctcagagactcctgttctctagcttcttcataatcggctttcaaaataggatctgctgtcagcgatttatccctttagtgctaggatggtaaataaattttatcttgcatgccaactctaaattattagtagcagccacctgaaatgctacgtgaaggattctggggatgcatccagttgaattagttatgagaagaaaaattggctactataggaaagagaatcaacaattcaatggattaaacaaaaagagtgttaattatttcttacatgacagtatcaatgtaaaaagttcaaatcagagagggaattctgtttcttagtcattcagggacttgatttccttccaagtcattgtactttcatctcatagggaatcactcccatctgtatactgaaactgggtagccattacatctgagttgcagctggtgggagaaagtatggaaaggagagcataccctatgtcttaggacccaggcatggaaatggcatacatcacttctactcacattttattgatcataacaatcatttggctgcacagaactgcaaaagaagctgaaaaatgtaccctagctgggcagccacacatcaagcaagaatgggagaatgtattttggtgggcaacgagcatttttgtcccttactaggcttaacaggaatcaatgctatgattaattaatgaaattttccacgagttggaaaaaaactgtggcatccacccatattatggtattagctgatcttgccttaagtgtgaaatggaagtcttgttttctttcctagagggtcctgaagtttaaatataattccaaaaaatttgacaggcattttccactatgagaaaggtacttttgttaggtacaaaaataaacttgtccctgctttatcacttaatgtagaatcaaagattcgtctccagataacagaatttcagacatcagctaccaaggagggaaaatataggcttgggaaagaaggccttcttgtatgaaatcacaccacacaggcactagacagctctacttatataaagtttagctctataaaaatgagattggggtgtttcagagattttattaggaaatgtacagagaaaacagttgatggggcaaaagctataaacactaaggtgagaaggaatcagaatataggcaagagttatagaagcatctaaatggcatttgtatctgtttaatcagcctatcaggtaaatctgcccacttttctccctaccagtgaacatctgttttgaacctctaggatatgggacctcttgcttgataccagtctttctgtgcctacctattctaaagcctgatgtcatcttctgtgccttcccttataggcttacttccttcaacgctgaccattcctccagcatttcttattctaaagaggaacaggtaagaaacttcgttggagggaaaattaagcaaggattggcattagagagggagctgtgcacagtccctgtctcaacaaaaatagcttaagatgagacaagtactttacttagcataatcttgctactgaaggggctattctaaatgtccccccgcccaacaccattatgtaaacattctctaatattcgctacttaatttagattatccacccttccttctggccattgcattccttatctagcaatgcaggaaaagggcaagaaatcaaagggaaggaataaagggacttctgtttccagactgtattttaaagggaagtcatggttggttagcgattttctttagcttttgctttgcgtttgcagaatagctaatattattgttttacctatgggaactggtatccaatctagtgcccaatggggctgttgttactagagctattttctgtgaacctcatagcagactctcttctgctgaaaatgagatttactattcattctgggttctctcaaaagccagcctgccatctacaattagcggtcacatccatttggctatagttcaggtaagtccaattcttcatgtcctgcttctcagctctctgctgctcagagccaaaaaccttatcttagaaccccaaaatacatgtctagttgctgtatcaaagaccaggtagcagcctttacagaaagtcccttttctcagaatctagttgagccaatactatgcagtgtccactatattcttcttggttcattctctttcttttggaggcaacagcttactatggtgaggacaactggaatccatctctacctattcaccactttttaagtagtaaaattggtagctcaaaagtaactttattccctgctaagtcttgctctttccaattattattcaaacatgagaggtgacagtgagaagattggtttggcattataggatggtaccatgcaaggtactctaacaaccggccttctgtctcatggtctatctccctgcagattcaggttgcatcagctgtcctcctatgtccacaatccaaatgctatgggatactatggcagacaagttttccagttcttcaggaagtagcaactgtgagtattctagctcacaatgggaggagcacaacgactggactccagccatgagcaaatacaagtaaaggtttaactgagactgtctgctccccagttctccaacccctgcctaccccaagcccctttttgtcttgatttatagtagaaaagtaatagtcggtcgggcgcgggggctcacacctgtaatcccaccactttggaaggacgaggcaggtggatcacccgaggtcaggaattctagaccagcctggccaacatggtgaaaccccatctctactaaaaatacaagaaaaaaattagctgggtgtggtggcaggctcctgtattcccagctactcagggggccaaggcaggagaatcatttgaacccaggaggcagaggttgcagtgagctgagattgcgccatcacactccagcctgggcaacaagggcgagacgtcatttcaaaaaaaaagaaaaagaaaagtaatagtcacaaaatggatataaaaagagaggtaacaatgggaaactacaggggggcaaattaatacttttatagtttcagcagacctgtagtaacagaagaaaaactgattttcacttggttcagactatctccctgggctagaaagtatagggccaaggtagaggaatcggaggtagatgaattatcttcctgtgtcttcctttaagtagttcacattgctcccatttaggtaccagttaatagtcataattactataatccctctctttggatattctctaagactttatttcctcgtgagcataaagacataaaatagtacactggaggttagctatgattaggaagagccattctaactgtaaattactcataatccaagctctttcctgatgagcatgtatccgttataaaagaggctatgataatatacagtgagaaaagaatttgtttagaaattaagtgaatttggatctagggtcacctcagctattttgcgctgcgacattgatcaagttattttctctgggtttcagatgcctcatctttattttgtgcatttagatacacaattctaattggcccaatgggaattacacagctaacaccatcatgcagcaaaacaaaataaaatacagtggaactgaagtgagggagtaaaaccaccacactatgcagatgagactatctgcctagtaacaagacatttcttggactctggtacttcagccaaatgtcctctgggagtggagaggcggggagacaatatagtccactgccagaaagaacccacatctgttccaccactctcattgtcattgcgtttcctgggatactttcagaataattcattagtaacaacaacaacaacaacaaaaaaaaaaaacagcaaggaaaaggctacaaggggaagggtttttctaggtctttgggatatatctaatcatttcttcacggaatattataaagtagggtccactcaaagctcatccctcacaagccactcaacctttgacattcttcttctatttaatgtgagtcagaattcctaagattttttgaaatcctgcctgcaaagtctgcttatgaatttttttccttaccacggagttcccataaagtgacaggttctgcctaagtagttagctacctgcaaggctgctcgaatccaactttctttcccactctactttgcattctgctctccctttgctctcctctccttaggccctcaagtgatgccagcttttgttctagcactctagaaaggagttactattttgatccagagtacacagagaagagaaactggagtgggtaaaaggaagctcgtcactgagaatgctggtactgggagcaagactgtggcaaacccaggaaatactaacaataagaacccctcaaaagttcacctttaccaagccaatggaaacaatatagctgagtggggtttgaattttgagaactaatgactcctcagctaccatgtaattgccttggtgctccatttgctataattcatgggaaaggtactaaggtccttcaactggttttccttgctacctccacctttttcagaagttggacctatgattagcacacttcctgcctatccattcacagtgaatagaatggctggctaaattttaaaccccatttaaattattccacttcgaaatttgaatgatagatgcttgcctaagtctactggcctcagtaacattaccttttctcatgaccaagggtaaaagagtaaattgataggaggcacaagtttttgtggatgtgggttgggctggcaccaaatccaactacaagcatacagtgaccacttcatacacaccacataaaaaatacaaaaactgaaaaatactatcaaatgctttgacattttctaaatatttctgctgcccctataaaattgccttgtctgacctttcctcactaaccaggagatacggtgtttttcatttcctctcccttcaaattttacaagagaatcaaggaatttgaggaccaaagcaccacaaacacaagagtaagcacagcaaatatgacaaggggactgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacataggtaagagttcttcaggcatcggttttaaaggtccatgtactgggacgggtgcggcggctcacacctgtaatcctagcaccttgggaggccaaggctggtggatcacctgaggtcaggagttcaagactagcctggccaacatggtgaaacccagtctctactaaaatacaaaagttagccgggcatgatggcgggtgcctgtaatgccagctgttctggaggctgggacgggagaatcacttgaacctgggagacagtggctgcagtgagccgagatcacaccactgcactccagcctgggtggctgagcaagacactgtctaaaaaaaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatgtttccacagaactttgaaacctataaagtcaaaacttttaggtctttagagagaaaatttcctcattcaacagaataggaaactggcataaatgggaaaatgtcttgccaaatatcacttgatgagtcactagagacaccactaccagtcatagccttataccttagttaaagaccagaactgccgggcgcggtggctcacgcccataatcccagcactttgggaggttgaggtgggcggatcacctgaggtcaggagtttgagaccagcctgaccaacatggagaaacaccgtctctattaaaaatacaaaattagccgggcgtggtggtgcatgactgtaatcccagctacttgggaggctgaggcaggagaatcgcttgaacccgggaggcagaggttgcagtgagctgagattgcaccattgcactccagcctgggcaacaagagcaaaactccatctcaaaaaaaaaaaaaaaaaaaaagacttccatcctgttttaagtgccaatcagctaggaaagagtccctttaaatgattaataactgagatcacaaaaataatagatatgagagggaaaaacataaggtcttcccaatgtttaaggctcacttcgatgttttaagacccctcaagtttgctttaagtctcctggctcaggactaacaaaacacagccttagagcagcattttcaaaactcacaatattgctctttgagataaaggtgagtcactctggaaggcaaatattctcacaataagaaaattcacataggttgtttaacattgcagctaaaatacaaaaaaaaagaagaagaagaagaagaaaaagaaaattcacatagactactggccctaggagaatttatctaaagattatgagtacaatagatagatcttcctagataactctcaacttagctttctagttcctagactttctaacaatttgttagtaactctctatttctaaatctacagagatttctagtcaattataacatttcaagagttcttacccatgaaaatatttcatgaaatttatagctacccactatttacgaagaatgctgggcaaagcctatacgttcaggatttattgcaccgaatggtcacctttatctgccaattctcactcgctaatcagcctctcccaacactgacctagagaatgtagggtcctggttctttagctcctgcctgatgacagataactttgtgccatttttagtcaggtttccatttgtatttatgcggcttccatcaatcagcaaccatagcataaaaagacacacctctcacttgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataacaacagctggccaggcgtggtggctcacgcctgtaatcccagcagtttgggaggtcgaggcgggtgaatcacctgaggtcaggagtttgagaccagcctgaccaacatggagaaaccccgtctctactaaaaatacaaaattagcctggcgtggtcgcgcatgcctgtaatctcagctactcgagaggctgaggcaggagaataacttgaacccaggagacagaggttgcagtgagctgagattgcgccattgcactccagcctgggcaacaagagcgaaactgcgaaaaaaaaaaaatacacgccacaaaaacagttaagcaaatctatgcagaaggaaaaacaaggtacagaaaaccagggattcagtaaattccttatacaggcccccggggctctcctattccactttttaacaatttcaattgtttttcaagctaagaaattttgatttcttaaaacaaggaaatggcagtgataatggaattaggcctaccaaaactgagctaatacagatgaagttagtcttatttgtaaacaaatcctgagaacttaatacccatctgccaaaggaaagtgggaataatttaaaaggccactaatcaaaaggtgttaagttcattaaatctatcttgctgtgtggtgagaaaagaaataatttagtgctttgcatctctcattcttcattggggatcaagtatgcttgcccttacagacctcactggagcccagctctgagggataaatgaaacaggccgaactcattatgtaaagttaaaatgtatgtgtacatgcaaaagaaaaagtataggaattgatgaaaactggctcacgttctgcttttctttctttttaagagactgggtcccgctctgccacctaggctggagtgcagtggctaatgatggctcactgcagccttgaactcctgggctcaagcaatcctgctgcctcagcctccagagtaggtaggactacaggcacgtaccaccatgcccaactaattttattttattgtagagacatgggtcttcaactcctggcctcaagtgatccccccacctcaacctcccaaagccctggaattacaagcaggagccaccatgcccagctgtgttctgctttaaaaaggagagttgtgggaagttcaatccaaagacagaagcactacaacaataaattccccaaactacctttttctccagatagctggcaacccatccaagtagattagctggagcttggccagattctcaaagggaaagatatgattaatttggagcctcttatagctgtttgcagtcctcaggtctcacatgctcagaatgtccttaagaagaaagacagggttcagtaggctaccaaagcaccggtaggataccaaaagagttacaaaaaccccaatgaaaaaaacctaggaagtataaactgaagcattagacataggtatctcctgtctctactttctagcctgcttggtctccctaaagtcctctaatgacaagccctggcagtacacgggaagattagacaagtgaagaaaaagaactacatgaaaatatgggtcaaaccaataccgaccttaagggctgacactaaatttgtggctaatggtcatcctgttgctgaaaatacttcaagattcaaggtggtgtggcaactgctactactgcttagaggtgcaattgtcttgactgtttttaataattggctatctacctttactatagcataggagctcactaaaggggatctaagccaaatttgcagtcttgaaagcactttgcatggtactgtatagtatggtgtgaaaagcacccagtatgttaaacctgagtaccttaaatgaatacaggcttccagatccctgatcagggattactgtatcatgaggaaacctttatgtcaatgtcaaacaggaatatatggaacatcacttattcaacactattctctagctttaaaaaggccaaactgttctatgatgttctcaatataagcagaacaagcttcaaaatctcttgccaacatccttccccatcctaatttaatctaagattagatacttgacttccaaatgcaggcttccagttaaacatggcggttcatacatgtttatgcatttactctactgcttcctaaaactccattaatgagagtaaatgtgcactccatatgcaagcaaatacacctaaagaaattttaaataaacggatcctagctcaaattcatttatacactggcatctaaaagggaacaactattccagtctccccaagtcttcttaagcatatttatggagtatcttgctttagcatcaaagccctctagttttgcctgttactatggtgatgacatactcaaagagcattccctttcccttaacgggaatctaaggctagagaaaatggttacattttggaactgggaatctaaggctagagaaagtggttacattttggaactgatacagaaccatacatttcactagggttcaatattcactgacaagaattttgagaatccgtcatcttgcagaccaacaaaatatcaaagtcttatggagagaataactgagtggcacagccagccatctggttcaaatactccagcatcagacagaattgtcacagctagacgtgatattaataatcacataggccaggcgcagtggctcatgcctgtaatcctagcactttgggaggccaaggcgagtggatcacctgaggtcagaagttcgagaccagcctggccaacacggcaaaactccatctgtactaaaaatacaaacattagctgggggcggggggtggggggcgggtgcctgtaatcccagctacttgggaggctgaggcaggagaattgcttgatcatgggggaaggaggttgcagtgagtcgagatcgtgctacttcactccagcctgggcgaaagagcaaaactccgtctcaaaaaaaaaaaaaaatcacataattcaacattttcattctctaaggaaactgggaacccagaagatgaaactacctcaatgttacacaaatagaaggtaaccaagtgatacttaaacccatgtcttcccacaattcaaaggtcttttaactgtggggtctgtgcatagattctcaggacatatggggagctttctacaaaactttcacaatactctcatttcactgtaaggatagtttagatcagctatatgactacttcataatataggaccacgttgccagattagtggcaaatgttctagttttgttgcctggggattacagaaaagaagagaagcaaacaatatataaatgtgttttgtgccaaatgaaagtgaaatagcattgctatgtgctataatggcaggatttaaagcagtttgaaaacagcagtttggtgaagtgcatcaacacagcatgtgatattacagacacgccactcaaaagaaactataatactataatagtagtgccatatttgcattttagttatctattaactactaatttgtacatctgctatgttttatagttgtattatagatgtaggcaaacagatttcattccaggtttgttcatacactttaacttaacaattattcccataaacctaaatagtacataataatatttttcttttacagaaaacgtttaatcaaatatagcaaaatattaattgtagaatctaagcagtgattatgtaggtgcacactgaataattcttttcttgagagaaaacctccctactatcaaacttattatacagacttgagaaacactgtctcaaactaatatctaatataaaatattaaaattatactcaacataatttcatgttattttaaattgctgattaatatgcaatgcacatgacaatgctgttaatcagggcactttttgtaacagcacaccaactttcttgactaaaattgaaaggttaaaaattatatttgggttacaattgccaaggaagacatctactccttgggtcttaaataggcactttggaaggctagctggaggtcagtaaatgaacctttcctatcccacgtgtgaacatgcctttcccttcctttcccacctccagtgttctcagggtcctttagctcttagaaaaaaacggaaagaagaaatgcatacccaaggaacagcttacctggcgatatcagaataatttaatctgaaaatcaatgtcaaaatgtggattgaagtaaattctggttcttaagataaagtttgtttctgcaacctattttacgtttcaaaactggcagaaacatttagggcagaagggtcatttctagtttcaagaataccctacagctaaactctccctaaacttaaccatagaagcaaatgtcaaacactcactaccgtaatattaacagaaaaatttcccaaccaagccaggtttctcactgtagaaatgggaggtaacagataagcaaggaggtgagactataatgatccatgtggcaatgattagagttggagacgtaggtataaacacatttagtttaatatagatacagatggttatatatatttatagctatgtgcatatacacacgttagaatgcaaatatatatctccttgctcttgtcaactgaaaaggtcttgaaggaatgacactccagtagtaatgagcgcacctagcattcacttcttgatttctaatattactctccaataaaaagtatcaaggctccttgcagaaatacatcattttaggtccaggcaggagatatgcaaatgagtctgaagcatgttgtagttccaaaaataagaaagtgctcaaacaaaaaacccacattcatggggttatatcaaagccaaatgaaagacctcccaatggccaaagctggaacaatttgaacaacagaataaagtaatactgtattataacccagagtataaaatatccctgagatcatactgatataaatgactgaataaacacaatacattgtggagaaaagacatcctgtgcaaaagaattccaaataatttatgtaaatactctgccctcaatgaggtggaaggtaatttcccattccttaagtgctggctgcacatagtgacttcctatgtgaacagtatagtagggaaatggagaaataaagactaattttacgctggagaaacctgacaaatagtacctcagacaggtgattaaggataacataaacagtgataagtcatgttgatagtatgtactcttgataagtgataagaatggcactctacctttgtggtcttcctcctaaacactcataaacccaatctagtcatgagaagaacatcagacaaattccaatagagagacattctatagaatactggaccattagtcctcaaaactgtgaagttcatcaaaaacaaagagtctgagaaactgtcattaccaagaggagcctaaggagacatgactactaaggacacatgcagcgtggtatcttcaatgggatcctggaacacaaaaagaacattaaggaaaaactaaggaaatctgaataaaatatggactctagttaataataatgtatcaatattggtttgttgtgacaaatgtaccaaactaatgtaaaatgttaacactgggaaaaactgggtgtgaagtacacagaaactctatcttcagaatcattctgtaaatctctacactgttctaacattaaaaggttattttttctaaaaatctcccaaccagttgctgaagacttataagacacagtttttaaaaagcaagcaaaatggaacctaagaactggtaagtctatgttccagatttttctacagtacgtaccatcattgtttgcagatctgatctaaagacttactctctttcttttctgtttatatggatttataataggtaattttgatgttaaaatatacaaggcccaaataaccaggtatccgtaatatcaaaaagttattttttaaaaaaacattagcaattaaactttgtttttgtacatcaacagatttcctggaaagacctagtcaatctgctgtaaaaaataagtcgtaagttagtagctaattttcagtcaagggagatctataaggctggaaaactttaataacatatagattgtagagtgattatatcccatcactgttcaatgccaatcacactaacagcatactataaaatatactatgccactagttttcaaagctatgggtaaagtaacatagataattttataatgggacctggtaaagtacagtgatgttccagtcatatccctatttttaaattcttatacgcacttgattatgtaataagagggtattgcttgggtctactgcataacctctcatgtttccgggaacactagaagactagcattctaattggttaaggaaaataatactttaagtctacccataatttaagaagtctagcaccggtcaaatttacattttgtttcagtttctcatcctaacatgaaaaaaaataatcaaaagttatttctaatataaacatcaaaacagtaaaggagaggcttctttaccaaactcatttgtataagatgcagaagaagcccaagctccatgtatcagtactcaatttggaaaggtcaaggaagagctatcaagtaaagcctaagtcaccaacaaaaacatgaccaactcgacagcctaatacacatatatatagtgatatataactgtacatggccactgaagtttaacttgttaaattcagcaggccagctatgtcttaaatacatgagctccaacttgagttggatttttgaaggaaacctgtgtaaaatgctacttgcctacagcccaaaatatggtagtgagaatatcaattttctcccaatccagtctttaagacaaggcagaggaaggcattagctctgtttaactgacacatcattactctttgccatccaaactgataaggtttgggggaagagaagaggcattagctcagttcagatataatcattagtttctttctctttaagctggtaacgtatttttccaggatgctttcacatataagaatattttagcagtcaacaaaggtcaactcttaattcattactttaagacatgaactcccttcaagctgtacatttgataatcagggcacaaacaccctgaaaagaaattatgaatgcctaatcacagcagccctgggtctcacagtcttctgtaatttagggaggtggctagagaaatggaagttacagaaagataaagctgaaagaggatatgagaaaatggtcagaaaacttcctccaatcctacatgttaaggttttataaagggaaaagtcagaaaagaaatgacaataatcatttaaagaaatgccaaaaaagtttccttcattagacttttgaaaattttccaaatcacaaaatgtcattttcagggatttaggtatttgatataagcccctatcttatttcactagcagtctcgagatggtcagattgatggtgatctgaaccaaactcagagccaggactaaagtctaagcatttctgcccaaaaccataatgatttccttctgcatcctccataagaaagcaaattccttgatataaatcctgtctttggttttgctatttattccagcacctggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctacataagttatataaaacacatctttgacaaagacaacgtgaaattggaaaacatatttacatttcaaatatctttgttaagtcagtgttcctcaaaacacatttttttaggatctcagaaaattttgttcctttagaaggtgtttcatcatgaagcattacttgggtttgagaaacaatggcacagaccatgtttccaagaaggttcaagaccatgatgtatataaccctcagtcagccagacaatgttgttaagcatatggagtggggctgggaggcatggaaacaagccctgaggaaatatggatatgaattaaaacgggctataagtgaagccagttcacttatatggttcttgttgctcctgctgtgatgcatgaatgtgcaccagaaaaaaagtttcgaatgttatgttaaacaatattttgtcagctggaaaacattaaggaggctaagcttcttttagctttacgaaaggtgggaggaaagaaggtatataaactacagcataaagtaggcaaggaaggtcaaggttttgacttcacttctccactaccctcttggcaaaaaggttccaaacttaaaaagtatctacgatatgcattatccatggtcatctgttcttgggcagaaatgtagtaaaattgtggaaggagccgaagtattagatttatgccctcaatctctgaactttaaaatactcaagcttatgagatttagcaatcactaatttgccaaccttcgcaaatagccaaacacaatggctatgctctatccctttcatctctttccatggctccaaaagaggtaaaaaacaaatgaaattaaaataaaccaactggactatccagatggctgcaatattaatcctatcttggcttaaagagaaaaagcaaacccacttccttaagtttattctatcaacttcaaatccttgtgggttcccttcctaaaactactacttatgattcacacaaaacagcacttattattttctaaagttatttcaaatgtgctcacattagctcctcaacgataaaatcatctcaggaatgaaattatataggatgatatcattcctacccaggttatcagtgtaacctagcatagagctgggtccacaatattaattctacagttctgctggttaactcacatatgtgtatttatgcatgtatgtatgtatctatttctctctctatatatatatattgcagatgaggtgggaagaaggaaagaaacttactggaccctctgacttttctataggtggcatctaagagaaagaaaatagaataggaaaaagattacttaatagctacgaagtagtacttacagtattctaaagagccagagactcttctttacagctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgctttttaaaagcacctctgcatatgttccctcatttaatcgttttactgcaatcttcttgaaataagtaggggcaggtgctccagatgaagaaattaaaggattataaaatttaggtagtttttctaaaagtgaatgctggtaaagcccacacaaagatactggtcttaagagttccactctagaatatctttgatattaaaatagcaagagtcagtgttctatccacagacccaccaccctcagttaaaatgagagacactggtcaccaggtacatagtataaatggatattttggcttcaaaaaaataatgaccaggttatcgagtccaccctacaatccagatgtctttcttaaaaaaatttttttaataataataagcaatttttctggctgtatcctggcatttggcactttacaataacaatatacaaaggggacaacaagagattcttaaccaggcaatctgctctggaaagaagaatgcagagaaagtgccaaccttccttcctggggagacaattttatagtgtacactggaaacacaaaataaaggatggcaatccagctccctgggtctgacttgccttcagtattttgcacagtaaagcagtaacacaggtgggcaagaatggttcttgtccccagaatctgacaataattgaaactaggatcattaataaatgaaagaaaatgagtgaaggcttatccacctagttcaggcctgcttttcatagtcaacactgcaccaacacaccaaagtggtagggagatcttggactgatgggctgaaaaatgggacaatcagtactgtgtttattaataacacagaaggggctttgggtagtcagcatactcagaagcaatgcgaaaggaagtagaggggttcatgtataatgggtgggaccaaggaaagtgcaactgagaattgtttaagtccaagagaaagggccttgtctggtcaacattacccagcaaagaggcaaaaggggcagggcagagggaagggaagagggagacagcacaatcttacctaatagctgcaaatatggacacctgagattgtgagcaatagtctgtaaaaaggggccaagggcacacaaggggcagagagagggaagacttcgtatataaagcatgacaccatggctacctgtgattttacacactggcgcaatgcaaaagggttgggagtatggaccactgtttgatagacaagtgcatggaatactccaatgcttatactttattatgccatgggaaactaagggtggggtggggcgcttgcttaacaaggtcagggagggagaaaaccattgataactgccattgtgcctattaacagtcccaggagaagttttgagtagtcagcagcccctgcagtaatgcaaaggggatactagggcataatatcccactctaccagaaggagacatatataattgcaaatattcacattaacagtacaaggggccttagtgggtcagtacccccgatgtaagcaacgaggaagcaggagtcttatctaatgatcagtgcccttgataattgttattaatgctattaattgtccaagagctgagattatgagtagttaacacttctcagcagcaatccaaagggtaatgggaggaacatagggtctttttctcctacacaggtccacaaatacaattatgacattaatattaaaagaaaagggttcattcataattaacatgcccctgatgcaaggggaatatgtggagatcaactcttagtctaaaagaagaggtggacaattgcattaatgcatattaagtccaaaagaaggggcacttagtgaatatcatccccctgctctaaagcaaaggtggtacaggaacatgcttagagaattgagtttgtgcacatgaacattccaagtgacagtcttgagtagtgggcactacctgctaaaaacactaagaaagtaggtaggatccttatctagtgcacagatcaggagcaaatgtaattgcacatattaacagtccaaaacaacaggactttggttgatcaggacaccctgttgtactacaaaggaaaggtgatggggtatgaccttaatctactgacaaagacaaaagaaaatttcaattatatgttgatagtccaccagaaggggccttggagggaaacagtataccccacagtaatgcaaaagaggtataatggtcctagaagtgatagggttgtggacaactgcaattattcacattaactgttcaaatgtaaagatcataaggagtgggcacccactattgaaaagaggtggggcatccttgtctagggcacaagaaccaacataaatgcaattatgcatgtcaacaagccaagaaaaggggacttagggggtcagcaaccctggtatactgcaaatggagggtgagaaggtagaactttgtttaattaggatgaaccatgtggtgattacatacattaatgtccaagggacattgttgtggtcaattaaaaccatgtactttggacaaatataagaatcttaaaaagtagtgggtactccttgttgaaaagcaaagggagtccatgagaaggtgcccttatctagtacacaagaatatagacaagccaagcaaagaggcctcagtgatcagcaccccagctatactgcaaagggggtctgagagtaggactttattcaaataggataagccatgtgcagttatgcacataaatttccaagatgcatggttgtggtcacttacaattgtgcaccttgattgtccaaatgtaagggtcttatggagtgagcactccctgctgggaggaaaagaaagattatgcgtagatgggatggggcagaggaggcttccttgtctagtacacagaaacctggacaaatataatcacacacataacaggccaggaaaatgggccttggttatcagcacccctgctgtactgcaaaaggggtctgagagtaaggccttattcagatgagataggccgtgtgcagttacacacattattgaccaaggtgcatggctgcggtcacttagaattgtgcaccttgactgtccaaatgtaaggttcttatggagctggcactccctgccagaagggaaaggaagattgagggtggggtggggcaggggaggcttccatgtcttatacactggaacccagacaaatataatcacatacgttaacaggccaggaagaggggccttggttatcagcacacctactgtactgcaaaaggggtctgagagtaggaccttattcagatgggatgggccatgtgcagttacacacatttatgtccaaggtgcatggttgtggtcacatacaattgtgcaccttgactgtccaaatgtaagggtcttatggagcgggtacttcctgccagaagggaaaggaagattgggggtggagtgtggcaggggaggcttccatgtctattacacaggaactggaacaaatataatcacacacataacaggccaggaaaaggggccttggtgatcagcacccctgctgtactgcaaaaagggtctgagagtaggaccttattcagatgggatgggccatgtgcagttatgcacattcatgtccaaggtgagtgcctatgctcacttacaattgtgcaccttgattgtccaaatgtaagggtatatggagtggacactccctggtggaagggaaaggaagattggaggtggggtgtggcaggggaggctttcatgtctattacacagaaactgggataaatataatcacacacataacaggccaagaaaaagggccttggtgattcagtacccctgctgtactgcaaagggcatctgagagtaggaccttattcagatgggatgggccatgtgcagttacgcacattaatgtccaataatgtccaaggtgcatggctgtggtcacttataattgtgcaccttgattgtccaaatgtaatgatcttatggagggggcactccctgctggaagggaaaggaagactgggagtgggggtgggggcggggggaaggcttccttgtctaatacacaggaacccagacaaatataatcacgcacataacaggccaagaaaaggggccttggtgatcagcacccctgctgtactgcaaaaggggtctgagagtaggaccttattcagatggaatgggcaaagtggttatgcacattaatgtccaaggtgtatgcctgtggtcacttacaactgtgcaccttgattgtccaaacgtaagcgtcttatggagagggcactccctgccggaagggaaaggaagattgggggtggagtgtggcaggggaggcttccatgtctaatacacaggaaccgggacaaacataatcacacgcataccaggccaggaaaaagggccttggtgatcagcacccctgctgtactgcaaaaggggtctgagagtaggattttattcagataggttgagctgtgtgtagttatgcaaatccatgtctaaggtgcatggttgtgttcacttaacaattacgcaccttgactgtccaaatgtgagagtcttatggagtgggcactccctgctggaagggaaaggtgagactgaggtatgtggagaggaccctccttttctagtgcataggatcccagacgattataatcacacacaacatgccaagaaaaggggactgcgttatcagcaacccttctgtattgcaaaaggggtcggagagtaggaccttattcacatggaatgagcagtgtgcgattacgcacataaatgtccaagatgcatgcttgtggtcacttacaattgtgcacctagactctccaaataaaagggtcttatggggtgggcacttcctgctggaagggaaaagtggggatgaggggagcactttccttctctagtgcatagcaacctcgacaaatacaatcacacatattgggaggccaagaaatggggccttaggtgtcaccaaccatgctgtccttcaaaaggaaggatactgatgtaattgtcattaggcacattaacagtttgagaaaggggccttaagtgaatagtaccccatgcaataaagcaaagagggtgtgataggtcagaaacccaagtctaattgaaggaccattgacaactgcaattacatgccatctacagttcgaagagaagggcttaatattgattagcactctctgctttgataagtacaggagtcctgataaaaggcacaactgtatgcaactgaaaatgtgtatataacacctaagattatgcacgctaactttactagtctaagggtcttaagtagtaggtacttccagctgggatgtaaatacagtgggtggggtccttacatggtaaaaaagtacagcagcaaatataagtatgcacattaacagtccaagagagtgaattcaggctagttagaagctcctgcagtaatgcaaatggagcaaggaagcgggattctactctaacataggggcacatcaactactgctaattatgcgcatttaagcagtataagagaagaagcactagctagttagcactcctgctgctttgccaaggaggtgtgagggggatgggattccagggcaattgtcttacttttttttttttttaatgttggccaggctggtctcaaactcctggcagtaagggatcttcccacctcagcctcccaaagtgctgggattacaggtgtgagccaccacacccggcctcagggcaattttgcataatagaaattcaagaaagactttaggaaatcagtacccccttctatgatgctgagaagtcaagatattagcttgatataaaagctagatattagcttgatataaaagactcagttctaatcaattagacatttgaaatgtcttagacaattgaaatcaattaggcaattgaaaatatgcacattaagagtcatggataattagaaatacacattaagagtcccaagagaaggactctgggtttccagcatccctttctataatgtaaaaggggtagaatataggtttaaagggagagaccatgaacattggaattttgcacattcatagtcccagggaaaggtaacataggtaattaatatcccttgctgtaaaacaaggaggataaaatggatctgatctgaaagacattgttgtgatcagttgccatggttcacattaactatcctagtgcaaaggtcttgactagaggtcatccactgctgaacactagggaagtgagtggggtctttagtgcacaggaagagggacaaatgcaagtagcacattaacagtacaaaagaaatgtccttgtgattagcaccctctactgtaatgctaagagggtgtgagcagttgggatcttaatttaatggaaaagaccataattgcaattatgcgcattaacagtcccaagtaccccctgctgtaagacaaaaggaatatgaggggatgagaccccagactaacagcagatagggaaattgcattttgcacatcaataatttctggaggaggggcattaggtaaccagcaccctcttgatgtaaagcaaagatgatgcagggaccttgatataaaagactcagttctaatcaattaggattgtgcacataaactgtcctagtacagaggtcttgagtagtaagggtcccctgctggaatacaaagggagtggaagggttagtgcacaagatcgtggacaaatacaattatgaacatcaatgcacaagaagagtccttgggtgatcagcccacattgtagcgtgcaaataggatacagagtccctttctaatggacaggactctggacaattgcaactgtgcaaattaactgttcaagagctgttattgaataatctgcactcgttagcaacatcccacagaaggtgggatggggtgagaatccatttttattgcacagaaccatgaatatatgcaattatgcatatcaactgtttaagagaaggaaacttgggtagtcagaactcagcagcaatggcaaagaggacatcctagactaatgagtgggactatgggcaattagtgttttacatattaatgcaaggtggtaggtagttcacactatctaggagcaatgataaaggcatacacataagtgggtcttctctgttacgcagaaccatgaataattactattgtatccattaatattccaagggaaggggctctaagaatgagtcagtcccactgctgttatgcaaagatgtttgcaaaggccatagtgtaactaacagaactatggataattgggattttactcaataatttaagaaactcttaaatctcaggtagtcagcgctgcctcaaggcaaatgcaagggcgactggtagtcttcatgattaatgggtgagacaattagcaattactactttgttctttaattgtccaagaacagcaggattctccagaagcacagcaaaaagcgcagtagggtgcctttgtttaataggcaaagctatgacaattgggactgagcattttaactgtccaacaaaagacgggttgtctgcgaccccctgctgaatgcaaatggggttcagagtgctgtctaatccaatgggtaggattattggcaattagaattttactcaatgcaaagagttttaggtggccaacacagtacacaagaaaagatcactactcaaaattgggactgtgactacagaagcaatgacagagaaatggtttctcctttaagggcaggggatcgagaaaatgataagtaactcaaattgtgggcaataatgctctgatagaaagctctcaattgacattccctaacttcaacgtaccgagtaaggaaattctttgtcctgagatcacagacaaatgggattgtatgcattaactgaaaatggtcaaggagtcagtactgaagatcagcaatgccaagggtaaacggaatatcccagtataataggataagcaatggacaacttattttgagcactgaatcaatgaaaattagagtgactttcgagagaagctgggcgggactgaggaactaggactgggactggggctagggctggggggttaggggactggggctggggcagggctggggcggggtgggagtagggctggggctagactaggggtttgctgggagcagggctggggaggaactggatgctaggcaggcaggatacaacgaaaaattgaaatactccaatataataagtctgaatagaggacaccagaccacagcaattcaagtttcctgtctgataagtaggtgattagtcaattagtgcagcatcaaggatgggaacaaagcaaggcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttggccaacgatcatctgtgatccattctggtccttgccacggctcaccaccatgtccacaccaagcaggcctggagcactgcccatggcaacagtgcagtgcagggcagaccagaggggggtaggggggtaggggggtaggggggtggggaggtggggggtggggggtgggggtggggagttgggggggttggggggtggggggggaggtatacttagccttaggtgaggcaccaatacagaggaatggagggaggttcagaccacacagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaagcaggtatccgaagccccgatgggccaaaaaaagaaaatttttaaaaagcagatatccgtcaccccgatgggccagagtgttgggggttcagaggggaagggaatcagcaggtatccgataccccgatgggctaaggaaaaaaaaataaaaagcaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccagccccgagagagtaagaaatatggctgcagcagcgaattgcagcgctttaagaactgaagggggggctgagggcggagagagcataagaggcgtggcctagaagattgaaagccggacatctttgtgatttggttggttcaaaatttacccagtaaggacaaaaaagggaaatttcaagaaagcaaagacataccagaaagaacattaactggaagtagacttcatttctagaccaggagtcacaacttcaatgggttttccagttctcatctataacatggggacattgagtaaatcaagcaataattaatgctaaaatcctccataaactgcataataaatgtaaagatgttaattcagcttggttttgagaatgggggaagggataggtagagctttgatgtgttgataaagtatccaaatatatcattcaaaccagaatttgtaactcctccaccaaacttttgaaccaaagaagctagaaaggagtaatacattgaggttagtaccatcttcaagggacttcccattccattatcccatgtaatagataatggaatatgtattgcatagataataataaaggattattcctgttttatacattaaaatagagtcctatagaggttacatcatgtgcccgaggtcacacaccatgattcagagtcaatgtagtttttactccaacactctaccttgtatggctcccaaccataagagaacggaagtgcttacgagtcaattggtgagcaagagagaaaaaggaaagaaagacatttcatagaatggctatttggttcctaaataatcaagaaagagtactgtttgtgacctgtttgtaattttttaactatgactccttaatctttactattttcctatttcctccatgaatctgaggaacccaacattggaccaaccatatgacacagtagtgaagttgaccctctgtcagtaactgataagtggtaggaagaaaaagctcatataaaagccaaagctgccctcagaaacctggctatttcagtaggaagcaattaatctcataaactcttctatgtcattcgagaaacaacagagaaccagaagggagacaatggcaacttaagtattatagagcaacttctagaaagtcaaaggatacattaccctcccactggctgaactggaaagtgtaactatcgacccaaatctatcaggtaagcttgctcttcagtttccagaaaaataataaagtatgcaaattttcttccttaagaaataccttccatcttctaagtgtccttggatcaaacaaaaaaagtaatctgacttgtcattccaaatgagggttattgtattgtaaagtggtgcaatacaatggtacctttgagaaaacaatgcttaacaaagagagaaactacctacagtgacacctatgaagcagctatcagaaagactggattaccaaacctctaatacaactttatctactagaagtttctacaagtgtggaaatgttctatacttttaagaaatttggttggccgggcgcggtggctcatgcttgtaatcccagcactttgggaggccgaggtggctggatcacctgaggtgaggagtttgagaccagcctggccaacatagcgaaaccccgtctctactataaatacaaaaattagccgggcatggtggcaggcacctataatcccagctacttgggaggctgaggcaggagaatcacttgaatccaggaggcggaggttgcagtgaaccgagatggtgccactgcactccagcccgggcgacagagcaagactccatctcaaaaaaagaaaaaagaaatttagttggggaaaaattttctaaagactcaagtagcatcaaatataaaagattgataaatttgactctgaaattaaaaccttttgtttcacaaaaataccttttcaaataaaaaggcaaaaagacaatttataaactggttgtcctgggtttctgtgaccaggccctggttccaggtgggcagccacgctagcagatcactctcattggttgtcattggagttttttaaatggtaactcttaaggctaggcatgcaaaatggtgctgatgtgccgttatggggtgacactcacattggacacaggacatgttcagagctgtggcctacctaaatccactgttgacccttaggctaaagaaactgcaaaagcaagaaatttataatttcaatacaaagaggttccagagtgccattgcaaaaatggaagtagtacagtgttgctatgtttttctcatagagggagatgtgaaattagccaggaatggtgcatttgacaataaacacaaagagatgatttctggacctaaaaaggaagatatggtgcaaggtcattataaaaattgatatgtgaactgttgaataaacaaatacgtaagcatctcttctccacctggtattctaaattttcattgataaatcactacacctcacatgggcccatgtatttgtaatatatttttaatcaaactgtttacattaaaaggaacttctgaaaaatatttgcctaggcctttgccctagagcagtcctgccctcttctgccatttatcaccttcaggttttacttactcccctgccctcactagctttcaattcactttacttcctcctcttcccgacctggcctcaccttcactactgcttggctccattttataaacctgttaggatcagaagtatggaaactgagacactagaaggaaaagtgacttgctcaaagtcaattagctagtaagag

SEQ ID NO: 37 - DNA, 58484 bp, Homo sapien
cttttgaaacataaaactacactgttaaagattgagtgacagggattggtgtgattaatggcattcaagaagtaaagaaaaaagaaaaagaaaaatttaattatttaattaaataaaaaacctctacctcagagcgaaacaacgggtccgacctcacgtcaccacggtagaaccgagtgacattggagacggaggacccaagttcgctaagaggacggagtcggagtggtcatcgaccctaatgtcagtactcggtggtacggaccgattaccaacataaaaatcatctctgccccaaaacggtacaaccggtccgaccagtgcttgaggactgaatttcactttgtggacggagccggagggtttcaagaccctaatgtccgccctcggtggcacggaccggagtaaagaaaaaaatttgatggaattagtgggtcacacccatttaccaaacttcagagtaaagaatgtcgtagtcaacgaaaccagttcctatgactcttcgtgtttgggtcattttttacactcttcgttttttgaactcctagttttcaccctctcctcttcccatatttgacattccgacacccttaattcgtaagtactttctccgggtctgggactcatccacttccctagaagtcacaaagatcttaagacttactagtttatgggtttgtaatctaaccactgaaatatccgtttacttggtcgtgtcataaaaaaaaaaaaaactctgtctcagagcgagacagaggtccgacctcacgccaccacactagccgagtgacgttggagacggtgggtccaagttcgttaacacggagtcggagggcttatcgaccctaatttccgcacatcatgctgtcgtccgattaaaaacataaattaaatcatctctctcccaaagtggtaaaaccggtccgatcagagaattgaggactggagtttactaggtgggcggagccggagggtttcacgaccctaatgcccgtattcagcggcacgggtcgggggtcgtgtcataagatatccgttctcaaggatgacgaaacaacctttaatttgacctttgaccaaaaaaaaaaaaagaggtctttcagaattcgacaatacccgggtctaccaataagtcatatacttgaaaaaaaaaaaaaaaaaatctgtcacagaacgagtcggtgggtccgacctcacgtcaccacactagagccgagtgacgtcggtgacagagggtccaagttcactaagagggcagggtcggaggtcttgtcgaccgtaatgtccgtgggcggtagtacgggccgattgaaaacataaaatcatctctgacccaaagtggtacaaccggtccgatcagaacttgaggactggagtccactaggtggtcggaaccggagggttccacgatcctaatgtccacactcggcggcgtgggcagggtcatgtacctggaaattttggctacggacttcttgagaatggatacacaattgtcaacttaaaacagtaatatttactcatctcaaactccactatttcaactgggtatagaacccccaacgaagacttgaccctaccacgatgtacctgaaaagagaaatgagaataaagaaacgttccgacctacacatcctgtctccctttcgtccactccgccattcctctgaaggacttcaataagaactcacagaagacaaggaaacaggtagggagaactaaggaagtcgtctaggataagggtatccccgaatgaagtcaggggaacagtataaacgacacgaatgagaacacaaacaccacgaaaccaggagtttaaggaactaagagaacattttaaacttccctctcctttactttttgtggcatagaggaccaatcactcctttccagtctgttccgttaaaatatccccgtcgtctttataaatcttttacagtttcgtaaactatcataaaaagtcaaaaacataaaaaatacaccacacatacttcaccagtgacatacgaacatcaacctaaaccacggtcgggttgggtgtaggtgtttttgaacacggaggatagttaaatgagaaaatgggaaccagtactcttttccattacaatgactccggtcatctgaatccgttcgtagatagtaagtttaaagcttcaccttattaaatttaccccaaattttaaatcggtcggtaagataagtgacacttacctatccgtccttcacacgattagtatccaggttgaagactttttccacctccatcgttccttttggtcaacttcctggaatcatggaaagggtacttaatatcgtttacctcgtggttccgttaatgtaccatcgactcctcagtaatcaagagttttaagtttggggtgagtcgatataacaaaggtaaccgaaccatttccacttgaaaactccccaagaataacaatcataaaggacccaaacggtgtcagaacgagggtcatggtcgtaagagtcactgctcgaaggaaaatgggtgaggtcaaagagaagagacacatgagacctagttttatcattgaggaaagatctcacgatcttgttttcgaccgtagtgaactcccggattcctctcctctcgtttccctctcgtcttacgtttcatctcaccctttctttcaacctaagctcgtcggaacgtccatcgattgatgaatccgtcttggacagtgaaatacccttgaggcaccattcctttttttaagtattcgtctgaaacgtccgtcctaaagttttttagaatccttaagactgagtgtaatttatcttcttcttacagtttccaactcaccgaacactccctactcgaaactcacctgggatgaaatattataaggcacttctttactaatctatatagggtttctggatctttttgggaaggggaacatcggaaaaggaacgacaaaaaaaaaaaacaacaacaacaacaacaatgattacttaataagactttcatagggtcctttgcgttactgttactctcaccaccttgtctacacccaagaaagaccgtcacctgatataacagaggggcggagaggtgagggtctcctgtaaaccgacttcatggtctcaggttctttacagaacaatgatccgtctatcagagtagacgtatcacaccaccaaaatgagggagtgaagtcaaggtgacataaaataaaacaaaacgacgtactaccacaatcgacacattaagggtaacccggttaatcttaacacatagatttacgtgttttatttctactccgtagactttgggtctcttttattgaactagttacagcgtcgcgttttatcgactccactgggatctaggtttaagtgaattaaagatttgtttaagaaaagagtgacatataatagtatcggagaaaatattgcctatgtacgagtagtcctttctcgaacctaatactcattaaatgtcaatcttaccgagaaggattagtatcgattggaggtcacatgataaaatacagaaatacgagtgctcctttatttcagaatctcttataggtttctctccctaatatcattaatactgataattgaccatggatttaccctcgttacacttgatgaatttccttctgtgtccttctattaagtagatggaggctaaggagatggaaccgggatatgaaagatcgggtccctctatcagacttggttcacttttagtcaaaaagaagacaatgatgtccagacgactttgatattttcataattaaacggggggacatcaaagggtaacaatggagagaaaaatataggtaaaacactgataatgaaaagaaaaagaaaaaaaaactttactgcagagcgggaacaacgggtccgacctcacactaccgcgttagagtcgagtgacgttggagacggaggacccaagtttactaagaggacggaaccgggggactcatcgacccttatgtcctcggacggtggtgtgggtcgattaaaaaaagaacataaaaatcatctctaccccaaagtggtacaaccggtccgaccagatcttaaggactggagcccactaggtggacggagcaggaaggtttcaccaccctaatgtccacactcgggggcgcgggctggctgataatgaaaagatgatatttagttctgtttttccccgaaccccatccgtccccaacctcttgacccctcgtctgtcagagtcaatttggaaatgaacataaacgagtaccgacctcaggtcagcaacacgaggagggtaacactcgatcttatgagtgtcaacgatgaaggacttcttgaccttttgaacagacggtatcatagggtatcgtaaacctaacacctgtatcctcctgtcgactacgttggacttagacgtccctctatctggtactctgtcttccggccaacaatctcatggaacgtaccatggtaggatattacggtttggttagaagagtgacagtggagagtacaaacttattattaacctttctcgttctgaatcgtcccttatttcaatgaaaactcgatggttaaaatgatgaatttttcaccacttatccatctctacctaaggtcaacaggagtggtatcattcgacaacggaggttttctttctcttacttggttcttcttatatcacctgtgacgtatcataaccgagttgatctaagactcttttccctgaaagacatttccgacgatggaccagaaactatgtcgttgatctgtacataaaaccccaagattctattccaaaaaccgagactcgtcgtctctcgactcttcgtcctgtacttcttaacctgaatggacttgatatcggtttacctacactggcgattaacatctaccgtccgaccgaaaactctcttgggtcttacttatcatttagagtaaaagtcgtcttctctcagacgatactccaagtgtcttttatcgagatcattgttgtcggggtaacccgtgatctaacctatggtcaagggtatccattttgttattataatcgataagacgtttgcgtttcgttttcgatttcttttagcgattggttggtactgaagggaaattttatgtcagacctttgtcttcagggaaataaggaagggaaactaaagaacgggaaaaggacgtaacgatctattccttacgttaccggtcttccttcccacctattagatttaattcatcgcttataatctcttacaaatgtattaccacaacccgcccccctgtaaatcttatcggggaagtcatcgttctaatacgattcatttcatgaacagagtagaattcgataaaaacaactctgtccctgacacgtgtcgagggagagattacggttaggaacgaattaaaagggaggttgcttcaaagaatggacaaggagaaatcttattctttacgacctccttaccagtcgcaacttccttcattcggatattcccttccgtgtcttctactgtagtccgaaatcttatccatccgtgtctttctgaccatagttcgttctccagggtataggatctccaagttttgtctacaagtgaccatccctcttttcacccgtctaaatggactatccgactaatttgtctatgtttacggtaaatctacgaagatattgagaacggatataagactaaggaagagtggaatcacaaatatcgaaaacggggtagttgacaaaagagacatgtaaaggattattttagagactttgtggggttagagtaaaaatatctcgatttgaaatatattcatctcgacagatcacggacacaccacactaaagtatgttcttccggaagaaagggttcggatataaaagggaggaaccatcgactacagactttaagacaatagacctctgcttagaaactaagatgtaattcactatttcgtccctgttcaaataaaaacatggattgttttcatggaaagagtatcaccttttacggacagtttaaaaaaccttaatataaatttgaagtcctgggagatcctttcttttgttctgaaggtaaagtgtgaattccgttctagtcgattatggtattatacccacctacggtgtcaaaaaaaggttgagcaccttttaaagtaattaattagtatcgtaactaaggacaattcggatcattccctgtttttacgagcaacgggtggttttatgtaagagggtaagaacgaactacacaccgacgggtcgatcccatgtaaaaagtcgaagaaaacgtcaagacacgtcggtttactaacaatactagttattttacactcatcttcactacatacggtaaaggtacggacccaggattctgtatcccatacgagaggaaaggtatgaaagagggtggtcgacgttgagtctacattaccgatgggtcaaagtcatatgtctaccctcactaagggatactctactttcatgttactgaaccttcctttagttcagggacttactgattctttgtcttaagggagagactaaacttgaaaaatgtaactatgacagtacattctttattaattgtgagaaaaacaaattaggtaacttaacaactaagagaaaggatatcatcggttaaaaagaagagtattgattaagttgacctacgtaggggtcttaggaagtgcatcgtaaagtccaccgacgatgattattaaatctcaaccgtacgttctattttaaataaatggtaggatcgtgatttccctatttagcgactgtcgtctaggataaaactttcggctaatacttcttcgatctcttgtcctcagagactcttcttcctcatggtatgtcttcccttatctataattttctctgactctgttatgtctggttggaatggaagaaatattggaagggaatccggacgagataccaagtgttatgtccaccctttctacacgagtctctttaatcccggttggtctaccgacctaccttttcttacagaatgtactttatcaaagggaaccaccgttacgatccctctctcttctagttattacttttttcagttttcttgataggtcgtggtcgaatccttctttcgtatccagaacgtttgttcagtcttgttacagattcttaaacgatacaattcaaaaaaagaaggttgaaaataaaatccaagttccccatgaaaacgtcgttttcggttacccatttaaaggtacccatttaacacacagtacccgaaactacatgtttactaaagtaatgtgaccatcactcgtatcatggactatccatctaaaaaactaggagtgagaggagggtaggatacaattagaaaattgtagaaaccttttattcttaaccgtgatcgaatacgtaaggtcatcgggtagatgtattttggtcactcccccggagtactatagttctatcacctgaattttctttaccctatgcatgacaagtagaacaaatcagggaaacacaaacaaaaagtcacaggatttcacctataattcgttcgactctcattaaactcatggcgaaataagacaccatctcaatggatcttttgtatacccaactcccgtacattagtacagggggtatagacacttttacctgtcattcttcaccatttgtaacaatccccgtcccaaggtgatcctttaaacctatttctctttacatttaaagtataaaagatgagtatccggtaaaatggtaatcgtcattatagatttatgacttttgtcattaatatcctttagaacccttgattttcagttgaattactactaatattaaaaggatctgaattgtgggtaagaaaaccatatgactgtcagggattactcctatgttcggtaaccagattttatccgtaacgaacagtgttggtttaaggagtaaatacagttacagacgaaattgattcaaggaaaccgaagtatagatatatcggaaaggttggtcactttcacagttgtaagggtgtcagtcgacaaaggagatattgaagtaaatggaaactaaacttaaagtaaaggtcgtaacactgaaatcaaagaaagaactcgaaagtaaaaataaccggttaagggagaaagtaatatacaaaaacaatttacagtgaacccaaatagtgaccgtctgtttctccgttgtgtttgtgtaccaaacaagagacgtgtacatgacttatcgactattcactggtcagtggtttctgacactttcttcactacactaagtattaactagtactacgtgtagacaatcaatatatcattaaatgtatgacttttggatcgtcactttaaacatgaaataaattatagtgtcagttatatggtaccattgactttaaatttgacacaacaaccccatgaacataataaattgatttggtaccacgtttcactccttatagactcagaaatgaaacttataactggtgaaatcatacaaacacttatatatacactttaacaaaaaaaatttgtcactctacagttaacatccgagagtacaaacgacaaaatttcatctacaagctatctcatattagtgtacatctaaagttatctaccgggatagatgttacgtgattgacagtatatgatgtgcacctcatttgttttttcagataaaacgataaagtccctacagttccggtcacagaagttccccttaagacatcgaaacatgtatttctttgggtcaatgtggttttgtgagtaacagatggtctggaagaccctaattaagataagttctatcgttctttttaatgattcggtttgttttaaaacttaacggttagtctttatgtcagtgtttaacctatttataacagtaccaccagaaaatttggaatgaaagtcaaaaaaaaaaaaaacacactcaaatctagttattgtcctgaatctccgaaaatggaagtttctctttcactggagtacaagggttactgatcccggagaactctccttcatacggattattaattttcgtttatgagatcccgtagtaccgggttataccatcgatgatcggtatatactgataactcatgaattttacaccgatcatgtttaactctacataatatttacattttatgtatgacttaaatacttaactaaaaatattaatggtgtacaattttattataataaacctatgtcatcaaatttaatgtatataataatttgaaagtttttattttgtttatcctcaacctttcgataccgaatggtggacaaaaacaaacagggtgttcgattgttacccaaaaggtagagatttacgaatttaaaaatttccttataaaataatgtacacttttaatatactttaaatttaaagtcaaaggtatcatgaataaccctttcatggtacaggtaagtaaaagtataacagataccgacgaaaacacgatattaccgtgacgactcatcaacactgtctatcgtataccttacgtttcagatatggtcaataagagtggagtcccgttaaaatggaggataccctgtagatctttacagaccttttacaaaaataacagtgttgactcttattctacaataaccgtggatccctcatcttcagtccctacgtcaatttatgggatgtcacttttcctttcgtgaggtgttgtttcttaatagaccgggttttacacttatgacaactccaactctttgggaccggattagatgaataacagaccgggaaactccttttttttaaagattggagaacagatttttgttcagtaaaaccaacccgcgacacccagtacggacatcagggtcgtaaaaccctccgactccgtccacctaacggactcgaatctctcaaactctggtcggacccgttttacctctttggggtagagatagtttttatgttttttaatcgacctgtaccaccgtgtgcatacaccaagattgatgaaccctctgactccaccgtcctactggactcggaccctccgtctccaatgtcactcgactctaacacggtgacgtgaggttgtacccactgtctcccttctggggtagagttttatttatttactttatttttgacaaaattttgatcctgaacagttgtctctcagtttgagatattttataaacttctctaaataagactcggttcatttatactcactggttatcgagtactgtgtcgaggttctctggactcttgtacatgggtttcatcagtccgatgtcgaaccaaaatatgtaaaatccctttgtattctgtagttagttacgtacattctacatgtaaccaacccagacttttacaccctgttgagattcacccccgaaggtccagtatccttctgagtctccaaaagactaatttcagaactttagttatcttccctcatagacgtaattgtattccccgaagactctgattccgagaatacgtctacttcggaggtccatcctccgaagtctctcttatctaacatttacaaagaatagtctgaatttttccatggtctgagaatcaattaagagaggacctattcgcttttctagacctttcccttcccgtaagagatgtcttacatccaaaggggtgttctctgtcgaaacgtcccggtaaatttttatacaacttatttatataaaaccccggacgatagacaacacaagtatagaataacgatgtttctcagatgaaacagttagaattccagagacaaaattacaattacaaccagtaaacacagatttaaggtttccctcctcctatattactccgtacggactggtgggtgaaggtagtaccggacttaatcagaaagtccaattgaaatcttacgggaaccgactctcctccccaggtaagtcaaccaaccccccgaatcttaaagtaaaaaccaaatgtctggaatatataagaataaataaaatgaatcaatataaactgataagaataaaggaactttctcagttcttaacggttctactttgtggaaaccccatagacctgtccaaaatggagacagttgggaacgttcttttaatcttaactgaatggaacccctacctcttatccactgtgaacacttacttcttttataacatcacttccggaacactaacccttttagtctcccgaaccactcccatgtttacaaccgacaacgacttttccgaagacactacctctcacttcgttgaccccacgtcaccccaccaccgtcaccacggtcaccacggttaccaccatcatcgacgactcacagtccggagactcgggttcggacgtgtatatgtaggtctaccggacttcgttgacttcttagtgttttcttcacttttaccggctaaggacggaattgactactgtaatggaacactttaaggaagaggaccgagtcttcgagggggtgactcgtggaacactggtgatggggacggacggtctcttgttgagggaaactaacattaaaaggtgatggatgggtttaggatattttgacggggtagggatagagggaaacgactgaaagaaaagtctgagtcgggcggacgtgggtccactaatttttcgaaataacgagtgtgtttcggacaaaccaccagagaagggtgcctacgtgcactgtaaaccacggtattgagtctagtcccctgaagggaaccctctagttaggggacaggaggacaagaaacgaggcactctttctaggtggatactggagaccaggagtctggttggtcgggttccttgtagagtggttaaaatttagaccattcgtcggagaaaaacgagagaagaggttgaagaaagtgatagggagttggagaaagaggaaagttaaagacacgatgggaagttagagagggaagggaattaaagtcacggaaaggaaaagaccatctctgtctcctctgtacaaaatacacacttgggttttgagactgctaccagtaccagagcccttctgtcagaagggagtcacaaattagtgacgcccctacggacggactaataagtgggtgtaaagtctccacagactagtggtacccctacggacggaactaggaagtggaaccaccgttcgtggtggaggggccctccgttcatggggggtggggaagagaggcacagagatgggagagaaaagagtcccgaacggaggaagtgatatccgtttgaaggtgggaggtaaggaggtagaagtgggaatctgacacaagagttattgaattttggagaagttgagtgtggactggattttggatttgtagaataaaagaagacgttatggtgaactggggttatgtttgaactgttaccaaggtttatcggtcttttgtcgtgaaagctaaagaggtaggatgttctagatctattaagaacagcattttacccgtttaccagactccacggactataggtccttaagaaaacgtgtagtcagggatagccccctggacgggactattagtgcatccaagaaaagataaagggattcgtaactgaccgaactctttattttcctgtctcatgttttctctatttaaaatttcgacccgtagaccccctctgtagtgtgtagccatcctagacactacggggtgttcggtgtttttggtcgttcaaaaataatccctaaaagtcttcccctccctcacacgcttatccacacccactgtctgtagttcatgaattgtcccattatcttatagtgttccgttcacctccgtcccactctagtgtcctggtgtcctggttccactttaattttaacgattgcttcaaatcccgtggtgacagtaactattatagaatagtcctctgtcccaaaactctagttggccagactggttttaaataatccacccttaaaggaaaaagattattcggaccctcgcgataccctctgacctcaaataaagtggggacgtcagagttggtattctctgtccatgcggggtccccccggtcaagtctctggatggggatccacgcgtaagagaaagagtccctatagggtacgactctttttcttaagtcgctataaagagggtaaacgaaaactttcttctcttcataccgagacaagacgggtcgagtggccgtcagtctcaaattccaatagacagaataagggacttgttaacgacaataggacaagtaaaaagtcccacgggtgtaaagtataacgagtttgtgtgtacgacatgttaaacacatcaattacgttaataatgtcccaggactctgttatatgtaggaggagttgactgttctaactctaatttaatttctgtccgtatcctttagtgttcccataactaaccccttcactattcacaggtactttagaaatgttaaatacaaatctctaacgttatttctgtccgtattctttaatgttttcataattaaaccccttgattatttacaggtattttagaagtgttaggtgtaagaagacggtaccgaagtcggccagggaggtaaaccccagggactgaaggacgttgttcagaaaaggattagagacgagggttacactgagtagggtttagaaagaagaaagagaggacagagaaggaagtcagaggtggggttcgagactcaggaaacttaggaggaaaagatgtctgggtagactggagaggggaggaggggtccgacgaggagtggtccgactcggtccagggttaaaaaggagtcggagacgagagggtgggatattaggaagatagtggaggggaggagtgtggaccaggtcgaatgtcaacgcaagacaccgatcgggagggggtagatgggttgtcaaaggagaatgtctccaccgacttcgacttccgtatcagttccaattacgaggaaaaagaaatcgactggagagggtttagtcaatcacaaatccgagaaaaagtagtatatatttttgggtcgggtcaagtaccgggtaaaccgttgttgggaatctgtgaaatggtgggatcgatctgggtcttcccagtcttccggcagagtaagagttatacgtaaaatagtgggtcagtcgaggactgtaatctttttcgaggtttttaatctgaggtcgggagtttggggtgttgtccttaattagttggagtggacgttccacatgttattatctcttctcaacgttaatgaacggaggtgacactctctttggggtcggtgtagaggtcgtgtgttcttgaagtatcgtggattcggtgtcgtcagtccgtaaggaaggtctggaggagggggtcctagaacgaagtgtgcgacctttagaccggtgacccggttccttacgacgtcggaccctaaggagcattcggtacagggtagatacgtcctggggtgacctttatcctaacaggttgagtggaccgtcgatgaggatgtcggggatttcgagaccaggttccgagagactgactgtgaaagggtctagacgaaccgaatcgtcgacctctgactgcgacggactagtggagtcttcggaggacctggtagtgtctgtgaaatccattgagaatgtcaccttccattcaggtaggggaagaattagttatacctccgatgggtgaggtgtaatggaaggaaagttcccggacaaagggaacgggggtattgccaacacccataactgccggttcgaagttttggggaattttgagagggtgagaccacggttgaacctgttgtaagaaaatacgtgagaaaaagtcaataagggtggacgggtcaagagaataatccggttctgtaaaattggtttaatagatgaagggaccgataaggacctgatgtcggtgtggagtaacggcggaaaaggggtcaagtttcggaggaagcgtaggaggggaacatagaggggtggaattaggtgttcatatcctgtggaaatgagggaggaacccctggctagtacgtggggaatcgtagggtaattttgtgttagtgggaatggggcgagttacggttatagggtagggtgttgtacgaaatttttccaatttcggacaatagtgagcggacgacgtcgtactcgaagacttcggatatttgagaggaatgttaagagggtaaaatggacaggtttttggcctgttcagaatgtccaatcaagtcctagacgtggaatagttggtttaacaaacggataggtggggtaccacggtttgggtatatgagagaataagaattatggagggaagtgttggggaggtgttgggtaataatacaagacctagagtttatacgaaagaaatgataaggaaacgtgggaaggaggttccgggagaaatgaaaatggacctgactgggactgtgggtagtcagagtcgttgaatggacccgacatgacgacgttccgaagtccctgtcgaggataatgaagtcagtccgggaaagagtactaaatgagagaaaggtaggtagatgtagagtggaataatttataaaactactggaagatgaaatatcggggaggatgtttagaagggttgtcctgtgggaggacgacgaggttgttagataagagttttcctgtaacgtgtagacggaggtttcgggtttaaagaaggagtaggcaatatatagaactgtattaagaagtatttttgtgtgtacgagagggacgactagcacagaccgattagagggtttggggttgggggaactgtttcgttgttgaggaaagaaaggactcgtaccaagtcatgaaaacggaaatttatggatcgaaatgacaggactgatttggtaatatatttgagtgttttcttttggatcgactggggtatctaggatttaggaaaggggtgaggaaaaaggtaaagaattttgtcgggaccttcgacgagggtgtgatcgagagggattgagtagacttgggaaaaagtaatgtgtgtcgacttcacgtcccgacacgccagtcttaagaatgtgttctcggtcctggtactggacatcggaaagacaggttcgttgaactagaatgacaaaatccgaccgagggtgtaataaggactatggtgtggactgggggtactgacatagaaagactagatggactgtaagtgaggtaaatgggtataaagtaagaaaggacaaggagtgggactagtgtgaaccaaataactaccgtcaaggtagtccggattaacagtgagtaatcgtttccgtccgatacgatatcatagaaggtgtagataggaactacaatggtgagacaggtggaggtgatggacagtcgttcggtttgagtaacggaattgagtccgagagtgagaacgtttccctgatgtgtagttataaatatgactgagatttatacggaaggtataggacgtggtggtacgacaatacatccgattttctccaaaggagcgatacgttcacaggaggtagtaattacggagaaattatttttgagaagagttccggtgaaatgaaggtttccttcgacctcagtaagtgaggttcccggtagttttccgtagtctagggtagtgagtcctgtcacgaatacgactattccatcgatttcttcgtcgatcacagggttgaagacagggagtaccggtcaaaaagaggaagagtagacagtgagggtggatgagagggtgactttgaaggtggatagttagagaaaggtgtgttccgtttaccaagaaccttgttccttttatagaggaaggtcggagtgtccggataagataagacaacagtaaaacattggggaaggtacattcaacgttcgacgataggacggagaattttggagagtaaaggaaaggaaacatttttagataggatttttttagtgaagagacagggtagacgatatgatgatgatgagtccttaaggagtccgggggagggaagggatgtgtagttcgagctcttaaacgggacgggtcctgaccgtttaactgaaatgagtgtacggggctcagtcctttgattttatggagaaccagacccatctgtgaaagtaacctacccatctcctgaaagggtgtcccagactcttccggtggtatcagtaaagaagggaagaaagtctgtattaaggatccgaaccggaagggtggagatatgtcagactattacctggccggaaataatcagtttagtgggttcgtcaaagagtccgagaaccataagtcaccttggaagtatggggaatggtaagagttagaagtcctctccatcttacctgattaccagaaaatttctgtgtagagtggttcgagtcggaggttgaattttttctaacctgtcatgaaaatggagaacggaaagagtcttaatctcggacaggaactctacgatctcccatgtcaggtaaatttgaaaatatatctgtgtgaaagaacgaaccggggttggagcagagtctgtggtcaggagatccttagatagacgaccaggaggtcgtccgttctgtcctttaaacggttcgacgattagaaaagaacggatgaggtataagggtcggtatatttctgtgggatctacctgctagtcaagaacaattcttagactggggagtttgagatattggaactatctggcctgggatgaatcagtagatattatggggttgacggtaggcggacattctgggagggataatccgagtggtaaggtcttatttcgacacaggtaacctgtcggtcggattagagaggagaaggaggatcttcaacgttcatgagttgggatgaagggaatttgagtgagtgtaaagacttcttgtcatcattgggaatactcggattttgtaggaaagtaagataattcaaataatgggatgaataacgttgttccgaaatacgtcagtgggggtgatgaacctgacgttggggttttgaacagtagggatgatagaagacagatcagtatgaggataagtggtaagagttgatgagcatttacgggacgggaacaaatgtgacggtcaaatgtgaaaaggaggtttggtagtattgagtatagaggaccaaaatggagtttggtggaaggaattcagagagaacttcacctatcttctagaagtcactgttccatgtgaggttatgaaagtgggattatttcaggataagaaatggaaatataagtgagaataagagtaaggacaagaatacgctgggagatggagaggggtcgatagaggtggtgtgatagttagagtaagtgagagaggatcgacaaagattaggaagaaattttttactaacgaccgaaacgtaaagagaaaggaggttttagtgactccggaactgaatgacgagtttttttcccctgacacacataaaaatttacttttcacaacaaaaatggatttagttagaccgaaccatatactgttgtatttttttgagttcctatctcgggtttttgagtagttggttcttttattagtgcgacttgggggaatccgtgagactaacctacaggactcaggagggttaagaatcaggaaattatggacaaaaagaggaagacaataaccctggaacacagaagacaaatcaaagagttaagtatgttttgacataggtccggtagtggttagtaagatacactgtttataaggaagattgtttaggtgttatagtggggaatggtgttttagaaggaagtcgaaatagagagggtgagatccaagggtgcggtggggattagggtgagtttcgttgggattctttgtagtgggtcattgagaggtatggtggggggttttttaaaaagtggcggggttgtgaagttgtgataaaacaaaataaaaagaataattatatttttctgtccttacagtccggagactcgggttcggacgtacatatgtaggtctaccggacttcgttgacttcttagtgttttattcacttttaccgaccaaggacggaatcgactactgtaaacactttaagtaagaggaccgagtcttcgagggggtgactcgtggaacacaggaggtggggacgggcggtctcttgttgggggaaactgtcattaaaaggtgatggatgggtttaggatattttgacggggtggggatagagggaaacgactgagagaaaagtctgagtcggacgggcgtgggtccaataatttttcgaaataacgagtgtgtttcggacaaaccaccagagaagtgtacctgcacacactgtgactcctacgacgtaaaacgaaagtactagggtttctgggaaatttttctttctcagtcctttaccccaccccccatatttctcttttatattgtatcttttgaatttatctcgtacattgttaacacacatagagacactaagaatatgagtttcctagtagtgtcttagaaccttaaaacatccttaccgtttataagactactggacgatcacacaatcggtcatccccattataactttgtttcattaaaaacgaaaaaacatcaaaccgactccttttccgaattttgtgtaatcacaccggtaggagtgacgatgtaagggtagtcgtggtactgtcaaatgtttacggtaccgttacagtccttcaatgggatataccagattttacccttccgtacttgttaggtggggaacaaatcatatagtagttctttttttgtgtttttacccgttggtcgtcgggaaccccaatgagacagatacctcatcggtaagacaatgaggaaatgaaaggattatttgaaccaaaacgaaacgtgacgcctgagcgggacttaagaaagaacgtgttctaggttcttgggagaggacccccggacctagtcctaggaaaaggatattgtagaaagactaatagtgtcttccctgatatcacgtctttatggactgggtttccaattaaaacccattcacaacccccaggatattgtagaaaaaccgttggtgacttcactgatattacgtctttgggggttaggtttccgattgaaacccattcaccaccccggactattgtagaaagaccactttgagcttccctactatgactcctctgggggtcgtgtttcctttatctgacgtcgtaatgattaacctgttgaaacccattcaccaccccatgagtccgtttcctaccctaaccaatatcgagttgaatcccctcaatctcagagagcattctctcccaatttcgaaggagagttattttccgttcctacgaactgactgtgacccaatctccgggttgaatcctcctaatctcagggaaaattctaaatcccccaatctccagggagagtcatttcagggagaggaatttcagggaaagccgattcttgtccaaaccgtaatatcctacaattggcgataagagaaacctaactagacggaacgtgagaaacgactaccgataccaactgtcttaatccgtacatctcctaacatcttgtacccctcgaaaagggaggatttttccctttactctcgactaccctgacgaccttttttaggcaagtactgactgttcgtcgacgtacttgaaaagtcacaacgacgttacccaccccgaaagagaccgtgagcctcacggcccggaaggggtgggacggagtccgttacgaaaggagagagagagagatattttgaccaacttacctaccgtttttagtgacaagtaaaggagacatttcaaaactaatcacttttttacctaaatactccgatcagaattcaacatcgtttagacaacacacagaaagacataacaagacagtatttctccccatagaatcctatcttgtactcgaatcctgtggacatttggacgacaagttctaccgggtcatttaaatagtccatgtttgaaacgacgtccagggacttttttgacctactccaaaggaagaacaaaacatacaggaaccctcgaactggaacattggtacaccgacacgaaaaagaaaagtgttaccaccggacacaagtcccaaactaaggacggaatcccctattcaggaaatagaagaagacacataaataaataattaaaaaactctgtcccagagggagacagtgggtcggacctcacgtcaccgtgttagaaccgagtgacgttggagatggaggacccaagttcgataggaggacggagtcggaggactcatcgaccctaatgtccgtaggaggtggtacgggtcgattaaaaacataaaaatcacctctaccccaaaatggtgtaactggtccgacgagagtttgaggactggagtgcactaggcggacggaaccggtgggtttcacgaccctaatgttcacactcggtgacgtgggtcggacagacacataaatatacacaacacacacactatattttttcgaaattaaccaagtttttattattcacgaatttagtctataaagtagtcttttgattttacatattacggaaaatcaagtaaactgaattcattagaaaccttttatcttttatcaaaatttctaatgactattttatttttatagaagtttttacatttgtaaaccagatttaatcagtccagtctataattcaaacgattgatgaaattccagtatttgacgaaggaactgaaaacttttaataagttacatggatggaacctctgtaatctaagatctattccagacccctgtacacctctcggtccgtgggatcgacatgacctttctcagtctggaatagacgtgaagacgaactacacaggatccgatccgaggtgtgatcatgtatttattttagagaaacccggacctaaccctggagaaaggacattgttaagatcttgaaaccctccggttccgtcctcctaacgaaccccggtcctcaagttctggtcaaactcgttgtatcactctgggacacagatacttttatttttttttaatttttgatcgacacacatcaccgtgtgtggacatcaggattgatgagccctccggctttaccttcctagggaactcgggacctcaagttccaatatcactcgatactaacacggtgacgtgagatcgggtccactctctattctcggacagagtttttatttttttaacgtctattaaacatacctcactcttcatcctgaatctggaaaacttgtgacagggtcaatggtacaacggtaggaagaaaagggaagggagattaaaaagatatattacagatttttattttattcttcggatcttttagatgtgagtttcaagagtcaaaacctcactagtttttactaatattcacatttataactttttcctcctgaaccctagatagtttcctcaagtgacttgacagtttcataccttatttttgtcatatcctttactctgttttttcttgtttcttttattttgtttctatgtcttcttgaacttctaacgaaacccctcctatcctcgttttcacttcaattcgtaataatttgtatacatttctatccggactacaacaatggtaccaaccccaaaggacattatataaacttcattacagtaggaaggtagaaggattatttagaatgaacaagtgactagtgtagtcactaaagagaattaaagaactgaggtttcatctatataaacagtcaaatacgtctaatatggacgtaaacaccctaacaaactaattatatacagaagtagggagaagtctgaccttcgaaggacttctgtctccggttccagataaaattggtggaaacacaaagataatggaccgtgtaagtccgagagttgtttatgtacaacggacttacttacttattgggtcgttaattcgggttacactatagatccaatgaccaggaccaaatcaatcggtgacaagtgttgggtgtacaagatcgaggtatggaaaggtagagatatgatttcttaggtgaagagagaataaagtagagatgtcatctctacgagtttcccttaaaaaaaaaaaatctcttcagagggagaacagggggtccaaactcacgttaccgagctagagtcgagtcacgttggaggtggagggcccaagtttgttaagaggacggagacggagggttcatcgaccctaattcaacggacggtggtgaaggccgattaaaaacatagaaaatcatctctgttacaaatcatctcagtggtacaaccggtccgaacagaacttgaggactggagtccactaggagggtggagccggagggtttcacgaccctaatacccacactcggtgacgtgggccggaaaaaaaaaaaaccgagtttcccttaaagaagtctgaaagacaaaacccaagtagtgataaattaaggggttaggtgatatcagtcggatggtgagggtgttgaggtggctatcacaaaactatttttagtggttactagatagattccctgagtaatacgagtagatttgaccgtcgaccgattggacaaagacaacaatattaaggagaagagagaaaattttttgaggacggagagagggaatcaacgacattgtatagtgagataaccaaatggaaattggagagaccgataataaaaacttggatgaacccgaaaacgaacttcccaaatgacgacagaaaggtctaatttcacaaaattaatgtcttcgaaatagaaatggtattatcttaattttgtaaacgaatatgatactattcttactatttataatcgttactctttcttaaataactacacatctatttactccgttacattgatattgtgatggatctatttctactaaggtacaaaaggactaaatcaactttgactaatagaccgactcaaatctatcaaaagacgggtcttcggtcttgcaactgatccattgaatattctatgaggaagatagggaccgtaagatggtaaatatggtgtaaaatacacataaatttttataggtcggtatcggtcagtgagaagagtgtaccacctgtcaccaaggtgaaaattaacgaataaatgtttctctaactgtagacataattcgagatagagtttctacaaaagtacaaggaagaggtgtaacgaacacactcagatttttttttttttcttgtcgtttctctatcgggacttgttacgatataggtgtaccctggacctgaatcccttactgtatttttatcttaatccccaacactaaaggtgatcgatgaaacgacagtatctgacgtatagtagaaatatactttaacggaaggtagatccacaatatctgacttaacacaggagagttttaagtatacaacatccagactgaggtttacactgacataaacctctatcttggaaattcctccattaattccaatttactccagtattcccacctcgggattaggtcatcctgaccacaggaatattcttccacttctccgtagtttggagagagaggagtgtatgagtctccttcctgtaaacttctgtgtcactctttcgccggtaaccgttcgttccttctctctgaagtggtctttagtttgaacgaccgtgaaagtagaatctgaagatcggaggtcttgacactcttttatttaacaataaattcggtgaaccagactataaaacaataccgtcgactccgtttgagtatttcatccacttccacaaaaatgtctcttcaacattttctatgtgaaaggataggtaatatgtaatcagataaggtacggaggagaagaccaacacagatattggaggaattaagggatatttcctatatacatgtatcgtgatcttagtgtcctcgtaacatatcaaagaaagaaaaaataaaaaaactctcttcaagaccgagatgacaggtccgacctcacgtcaccgtactagaaccgagtaacattagaggtggaatacccaaattcggtaggagggtggagtcggaggtctcatcgaccctgatgtccaggtgtgttggtgtggtccgattaaaaacacaaaaacatctctgttccaaagtggtacaaagggtccgaccagagcttgagaacctgagttcgctaggtgggtggaaccggagggtttcacgaccctaatgttcgtactccgtgacgtgtaccagtaacatgtaaaagaattacgacgacattgtttaatggtgtttgaactcccgacttttattgtgttaagatctacagtcttcagattttacgtagagtaactcaattttagtggtacaaccgtcccgacgtaaagacctctaagatcccttcttaggcaaaagaacggaaaaagtcgaagatctccgatgagtgtaaagaaccgagtaccgggggaagaagatagaagtttcggtagttgacgaccatcagaaagggagtaacatagtcagactgtgacttagaggacagacggaaaaggtaaatattcctgggacactaatgtaacccgggtgggtatgtttggtcctcttagagggtagagttccagtcgactaatcattggaattaagggagaacggtacactatatcatatcaatattcaaaacctctaatgtcacatctgtagaaataccccgtaataagacaaatagtaactacagataagtgtaattacgtccattcttatacatatccataatattttaactattaaaggtataagaaggagaaagggtgtaaatttatgacttatgattaaaaggaagaaaacttcgaacccgggtaatgatgtaatcgtgataatgaccactgaaatccaagtagacccgtgtcactcacgttatcctcctccctacatctcatgggtagtacggtacgtgatacttaaacgcctatgtccgattagtttttaaaaacggaacccgaaaaaaaaaactctcgtcctctctaaaccatagttacataattttttcgtgaacctaatagacacttaagatatacttattatatcttatataattgtatataattatacttacattatatatattaatatatatcttatatatattaagatatcgtagacacttacgatatcgacccaagtgggacggggaatctttgtttcttgggtcttagtttaaagatccagagttgaagttcacggagagaatctattatttcacaattcatattatacaagagtcaataaagtttacgacggtcacgaaaaaccgaagtcgattagacaccgaactgaaccaattcgatgagttaattctcatttataggtgggaatggagtcaggaagtttggaattaagaaagtattaccctatttttgtgagttactatttcaaattgggtttccatctgttaatcttttcgaatagtcgacacccattttcgtgtaacaaaagggaaaagggaagggaagggaagggaagggaatggaagggaagggaagggaagggaggggaggggggaaaggaagggaagggaaaaaagaaagaaaagaaaaaagaaaagaaaaaaaaaactctgtctcagagcgagacagtgggtccgacctaacgtcaccacactagaaccgagtgacgtttgaggtggagggcccaaggtcgttaagaggacggatggaggactcatcgtgcctaatatccacgcacggtgatacagaccgattaaaaacataaaaatcatctctgccccgaagtggtacaactagtccgaccagaggttgaggactagagcactagacgggtggagccggagagttgcacaaccctaatgtccgtactcggtggtacgggtcgtacaaaagatcgttctattgtttcttcccacgtaaacctaagaacttagaataaggttctagttgactcttaaatcggtattcataaaacctttcaataaggtggaggaagtttaacccaagagatggaatatataatgtattgtttacttgtgtgaaactatgaaaagggttgtttcggaaacctatctttggttcttcgaaccaaacgataaaagtacgaataccgtaaacgagtggattgaaaatcaatactggagttttcttttccgggaggagagaaggagtgtgatgaaacgagtaatatacactttaagttgacagggaaactccggttgatgattaaaaaggaaagacgaagggttcttttaatctctttaaagtcttaagtttatactgttgaaaatgttcagtatccggttggtagttcaacagtagacactatacctttccccttcccctacctagatccaagtagttcggtacctaaaccgtgacgaactgtgttattcggaaggtctacagaaatcacttaagtattaattttatcagttttcctagttatggaaacttctttgttaggttcgaggttccccgtcttcatccgactcatcagtgaaatttaagttagttatgtaaattgtttataagtaacttatgtataatttaccatcacaatccgtgaccgattatttggttgtctgtaacatggaatagtttaccttgaatactagataactccctctgtccgttattggtttttttttttttttgtatattaatatgtaacactattcttttaatttccctttctttatcctacgttactgattattactttttgtcgtataaatgaaatctttctcactaatctcttctttagacacttttccatcataaatttcggtctacacttcccatttttcttcggtcggtcggcccgtgccaccgagtgtggacattagggtcgtgaaaccctccggctctacccgcctagtactccagtcctctagctctggtaggaccgattgattgtgtcactttggggcagagatgatttttatattttttaatcggttcgcaccaccgcacgtggacatcaaggtcgataagccctccgactccgtcctcttaccacacttgggtcctccacctcgaacgtcactcgtctctagcacggtgacgtgaggtcgggcccggtgtcgctctggggcagagttttttatttatttatttatttatttatttatttatttatttattttcttcggtctgtaacttcggtaggttcaaacgtgaaaggtacattacattcatttcttggttaactccatctatctccagtcctttgacgtcgattacccggtttagactgtacgacgtaggaaaaaatatcggaggttcgattcttactagaaaatgtaaaaataactaaaaaaaaagctcaacctcagaacaagacaacgggtcctacctcacgtgaccgcgctagagccgagtgacgttggagatggaggacccaagttcactaagaggacggtgtcggacgactcatcgaccctaatgtcacacgtggtagtacgagtcgattaaaaacataaaaatcatctctgtcccaaagtggtacaaccggtgcgaccagaacttaaggactagagcactaggtgggtggagtcggagggtttcacgaccctaatgtccacactcggtggtgtgggtcgactagaaaatgtaaaaatttaccaaccttctttttttaatatcttataaagtactgtttgttttttatataatttaagtttaaagttacaggtaattatttcaaaataaccttatgtcgtttcgattacgtaaatatataacagatatcgacgaagcacgaagttgtcttctcaacatcaacgttgtctctggtacaccgggttttcggattttattactcatagtccgggaaatattcttttctaacggttgaggaaccgacctcatatcttttattcctcttaccgtactctacacaaacttttctatcttttttttctgtcgtttttctgggttctagtacgtcctataatgttcgttttctttttaaaacttaaaataataaaaatttcaaactacatactaatctttggtgacttcctatctttcgtttcctcacaatactaggttaaatacaaagtctttccaataatactgtaaaccgaaacccagtcttacatcttctatcactttctggtaataagggtgacattgttgatcttttttttgatctattgatgttgtgtttacctgtagtccctaaagacccaaggtgtatcctacatcttttgaccgtttccgtcggcccgcaccaccgagtacggacattagggtcgtaaaaccctccggttccacccacctagtggactccagtcctcaaactctagtcggactggttgtgccactttgagactgagatgatttttatgtttttaatcggtccacaccacagtacgttgacattagggtcgatgaaccctccgactccgtcctcttagtaaacttggaccctccgtctctaacgtcgctcggttctagcgtagtgacaggaggtcggacccgctgtctcgttatgaggtagagttttttgtttttgtttttgtttttgttttttggaccgtttgcgtcacaggaggtgtattgttattctttttatggctatttgattttttagtattgaactccggtccgtaccaccgagtgtggacattaggatcgtgaaacccaccggttccacccgtctagtggactccagatcctcaagttctggtcggaccggtcgtaccactttaggatagagatgatttttatgtttttaatcaacccacaccaccgtacacggacatcagggtcaatgagtcctccgactccatcctcttaacgaacttggaccctccgacgtcaacaccactcggttctagtacggtaacgtgaggtcggatccactgtctcactctgagacagagtttttttagttttgtttggaacttaaataacttctcgactcccacgtcccgttgattgatcggacttgagattcctttctacctgaaaaagttcttttctgtcttgtacttgtgaccgagtggacacagttacccttctattccggaggtatattcgttcatactccttaagctaattttcaatttgtagatttccggttcacacccgatcgtactcacgtatctcgggaacctttggtgtctgaggtccccttaagtatgagaatgtccgtgtacggtggtgtaagccgattaaaaacataaaaagtatttctaccccaaactggtacaaccggtccgaccagaacttgaggactggagttcactagacggacggagccagtgggtttcacgaccctaatatccttactcgggacacggaccgataaagtaaagaattattggtagatttctaaagatgggaagattctactcaggaaactgaggggaaaacggaaagagtaaaaaaaaccaattaataggaatacaaaataatcgtggacattctgagtactccttttcgacgttgtcgtataaactattccgaagaacttggtaacaaactaagacatcctcattaccgtgggtcctatgggtacatcttcccagggaaacttggcatcgtaaatggtaccagacccattacccgtataagtcacccgcttatagtaccatttcggtcaggttgtactgaacgtatacttcgtatagtcgacgaagtacatcccacgcggtgaaccgtaaaatatccctctcaacccgtcaggggaagagtcccatttgtctggaatatcaccgaaaataagtaagatggtctgaccgactatgaggagctcttctcgttggaatgctgtgtattagtagtctaagtggttccaactttacttctttttttacaattcccgtcggtctctctttccagtccaatgaatgttttccttcaggtagtctgattgtcacctagaaagacatgtatgggatgttcggtcttctctcgcccccggttataggttgtaagaatttcgtttattaaaagttgggtcttaaagtataggtcgattttgattcgaagtattcgcttcctctttattttaagagatgtctgttcgtttacgactccctaaaacagtggtggtccggacggaatgttctcgaggacttttttcgtgatttatacctttcctttttacccatggtcagtgacatttttgtatggttttatatttctggttgttgtgatacttctttgacgtagttgattacacgttttattgatcgaccgtagtactactgtcctagtttaagtgtatattgttataattggaatttacatttgtccgattcacggggttaattttctgtatctgattgtttaacctatttctcagttttcggtagtcacacgacataagtcctctgggtagagtacacgtttctgtgtgtatccgagttttatttccctacctccttataaatggttcttttatcttttgttttgttttgttttttgtttgtttttttcttttggtacccaacgttaggatcggagactattttgtcttaaatttagttgtttatagttttctctgtttcttcctgtatgtattaccatttccctagttaagttgctcttctcgattaatagggtttatatatacgtgggttatgtcctcgtgggtctaagtattttgttcaagaatgtctgggtgtttctctgaatctgagggtgtactattatcaccctctaaaattgtggggtgacagttataatttgtctagttactctgtcttttaattgttcctataagtcctgaacttgagtcgaaacctggttcgtcttgattatctggagatgtcttgagaggttgtttttagttgtcttatatacaagaagagtcgtggtgtaccgtgaataagatttcaactggtgtatcaaccttcattttgtgaggagtcgtttgcgttttcttgtctatagtattgtcagagagtctggtgtcacgttagtttaatcttgagtcctaagtctttgagcaagtttaggtgtgttgatgtacctttgacttgttggaagagaacttactgatgatccatttattacttcaattccttctttatttattcaagaaacttttactcttttttctctgttacatggacttagagaccctgtgtcgatttcgtcacaattctccttttaaatatcgtactttacgagtgtagtctttcgtcctttctaaattttagttatgagattgtagtgttaattttcttgatctcttcgttctcgtttgtttaagttttcgatcgtcttccgttctttattgattctagtctcatcttgacttcctctatccctgtattttttggaaagttttttaattacttaagtcctcgatcaaaaaacctttaaaattgttttatgtatctggtgatcattctgtttattcttttctctcttcttagtttatccgtgttattttttattatttcccctatagtggtgactagggtgtctttatggttgatggtagtctcttatgatatttgtggagatacgtttatttaatcttttagatcttctttatctatttaaggacctgtgtacgtgggagagttctgacttcgttcttctgtagtttagggacttatttgtttattgttcaagattttaactccgtcattaattatcggatggttggtttttatcgggtcctggtctacctaagcgtcggtttaagatggtctccatgtttctcctcgaccatggtaaggaagactttagtaaggtttgttgtctttttctccctgaggagggattgagtaaaatactctggtcgtagtgacactatggttttggaccgtctttgtgttacattttttttaaagtccggttatagggactacttgtaattacgtttttaggagttattttattaccctttggtttaggtcgtcgagtggtttttctaataggtggtgctagttcaaccacagtaggcaccctacgttctgaccaagttgtatgtgtttagttatttgcattaggtagtgtatttgtcttgtttactgtttttggtgtactaatagagttgtctatgtcttttccggaagctattttaagttgtgggaagtacgatttttgtgagttatttgatccataactaccttgtatggaatttatttattctcgataaatactgtctgagtgtcggttatagtatgacacacacgttttcgaccttcgtaagggaaactattgaccgtgttctgttccttctggagagagtggtgaggataaatggtattataaccttcaagaccggtcccgttagtccgttctctttctttatttcccatacgtttgtccttctctccttcagtttaacagagacgaacgtctactgtactaacacataaatcttttggggtagcagagtcgggttttagaagaattcgacgttcagagtcctatgttttagttacacgtttttagtgttcgtaaggatatgtcgttattatctgtttgtctctcggtttagtactcacttgagggtaagtgttgacgatgtttctcttattttatggatcttatgttgagtgttccctgcacttcctggagaagttcctcttgatgtttggtgatgacttcttttattctctcctgtgtttgtttacctttttgtaaggtacgagtacttatccttcttagttatagcacttttaccgatatcacgggttttattaaatatctaagttacgataagaatatttcgatggtaactgaaagaagtgtcttaatcttttttgatgaaattttaaagtataccttggttttccttcctcgttaactttataaccaaaagatttaaccccctctttatctatacttcccgaacgaatataggaagtgttcacacacgagtgtcatgtattcatcctgatctaaaaaaaaaaaaaaactctccctcagagcgagacagtgactccgacctcacgtcaccacgatagagtcgagtgacgttcgaggtggagggcccaagtacggtaagaggacggagtcggagggctcatcgaccctgatgtccacgggcggtggtgcggaccgattaaaaaaaaaaaaacataaaaatcatctctgctccaaagtggcacaatcggtcctaccagagttagaggactggagcactaggtgggcggagccggagggtttcacgaccctaatgtccgcactcggttgcgcggaccggatctaaaaaaaaaattagacagaaagaccaactagacccctcctacgaccattttgacgttaagaatggtttcctcctcatatgaccatattgatgatattaaaaacaagaagaggtttaacggagtttaaaaaaagagagggaatggactacaccaccaggatcctggtcccgaggttaatattgaggatgattatcgtccttacgaaaaattcgttttttgaaatggaaatttggagatacaatcttaaggattttccgaagatccccacctaacacgaaggtgtaaaccgttttacctccgattatcacttacatatatcgatataacggaccaccatttttatcgggtgatcaagacatggatacattggaatggaataaccttaccctcatctgactcctcctccgtgaacgatctgatcataacgacggacgttaggtcgtgtcaccacaaagattgtagggaaggttttcactcaaactcatttatttacccaatttttaactctctttaatttgtaatgtatttatgaagttttctctgtcgttctctactgtgacggagaatcgggtcaataaggtctacggactttcacacttcaatatacaaacgactctgttgttgacgaaaaccttggactgttctaattttccttcggacatttggactcaccggagtgggaccctgtgtaattacgttctactacctaacctggttaataattactgacttaccctaagttatagaaaactcaacgtacgggaaaactacatttcctaggtccaagtttatggtccccacctgacactataaaattttatatataaaccagaagtagggtcaaaggaccgtatattgaggattttgggaaccttagcggtttcacgacagaaaaatataccattacaactgactgtggaagtcccatcccgaccagtggtctttctgtttccgtactaatctcccaacccgaaagttggggtagggggtttgagacctctcccttctctccgacttccagttcaactaatggttaccggttaccaaattagttggtacggagacattacttcggatacatttttgggttctcctgtaccaagtttctcgaagacctatcgacttgtatacctccaaggacctctcaccgtgtgggtccctcccgtaccttcgagatatggagaaagggatatggagtaggatgtgtagagaagtagatataggaaacatcataggaaatattatttggtcgtttatatttttgttaattttttacttttttcagttacacggattctggtaggtctattattcactgttttatatcaaagtttaggttcagactgtggattgggttacgacacactttgaatgtattggagaatgttggtagttagaggtcctaggagacgacgagtatagttttcgtcttcgaaagtcaataaagttattctaacacaaacacttcaggacttccctcctcggaagtacaaatcgttgtgggtccccctaccagtccgatattctaacattatacactgaaattattgttccaacttattgaaaaataagttatagaaaaaaaaaaaaactctgtcttagagtgacacagtgggtccgacctcacgtcaccgtgctagaaccgagtgacgttggagacgaagtgtccaagttcgctaagaattcggagtcggaggactcatcgaccctaatgtccgtgggtggtggtgtggaccgattaaaaacataaaaaccatctttaccccaaagtagtacaaccggtccgaccagaacttgaggactggacttcactaggtggacggaaccggagggttttacgacccaaatgtccacacccggtggtacggaccgaaaataagttatagaattttatataaatcttttaatataacatgaagacgtgagacgatttcaagactggtttcggtctctttatgctataatttttactgtttactcaaataacttcttcttagtgtttcaatcttaaaatgcttacagtataacacctgagtctgactcgaatacaaacggtgtttaaaatatcaatatttgaggagttcccgatctcattcctcacaagtcaaagagtttgaggtgagatgaatcatgaagaatcacacccctatatatactttctccttcctctccgactttagtctaagaaaaagacactcactaaacccgaaacttatggagtctttttgaagattggacgtcaccgatcagttgacaagggaccgattgtgagttctcatatctcgaagtacctctaaccgtctcgaactgggaagtactgaacctacactggagactatttatagacctcaattttcggaatatttccttaacacaaaaatatatcatgacctgtgactatctactctgtctcactcaaacgaggacactcagattaaacgtctaccctatttcccataaacacctttactctatttcgtacatagtagaaactaacaaattgacaatccgacgaaaactaaaaaggtatctagatattacttgtggaaacgtaagatcggaaaagaaaggaatcttgaaactaataatacagttcaccatatttacaaaagtaccaagaaatctacgtaacggtttagtaaagaatttacctctctttattaaatgtacaaattacggagagtcatgaccaaatttaaaacttttatttacgaattaccttattttttacatatcaacatccacgatgaaacatttactcttagtccgacgtctttatagaaaaagtactttacgtctcactttcaccgaaggaacaagataagaggtactaattgactctttagatcctccccgatgtgttttaccacctttgacctttcattttctcaaccacccccccccagtctccttctcactctcgttacaagaattggaattataaattttcgatagatgttgtctctacaggatattttccatgagttgataataaaaaaagagagaacgggaatggcgaaatatcggatcttgtacttccgaacggttcagtgtctccaattcaatgtctctctttccctacccttggtgaaaccgaagaaaccaggggtttatagacaagggtagttagataataaaaactctttctatgtactactcctgatttaagactaaaaaagtagaacaggtttaaggatagattccccagacccttcagtacgggatgtttagtatttaacagtagcctacccaaaataaattggaatatatatagcactgaatgaaaggttagactgagaccgtattgtaatgttctgttccttcttttaattttataaaatgaggttttgtacgaagaaacggtatagaactttaccggaacgtttcgacaagaaacacccctttttaaacgtagacatttcttagagataattgtatcgatctagaataagaaggtccggaagggttaggatttctctaattgattttcagatcgtggaaaatttctagacttatcctttgtaaacagtagataacagagattcccgtcggtgataatctgaagttttcttggaaccagaggtgttagaaaatagaattggacttgtaaaggaaagatattagggtccaggaatctatttgagttggttaacagttggtcttttacaaatttaaatagatatcggaccttaggggtggtaccgaaacttaacagggtggaaagacctggtttggttacataaagaatttacataaactaactacagagtacggaagaattttacatattttattcaacatggggttggtggaacccgtgtacaagagtcctggaggactcccgacacagtacccggtaccagtgagtataaaccgagtcttatttagagaagtttataaaatgtctcaaactgagaaaaacagctgttaccgatacgtgctaacggtgagtccatgactaaagacataattacaccgtacgatcccgaaccatctattttcaagtcctcagatctttcaaatctctttcctctgtataagaagagatcttgaactacttcctcctcctcccttgtccttccttatggtaattcgagattcttagtagttggttggtcgtcttttataaagactcatggaaaattactttatattctcaaaagataaaggggtttaaggtttcttgtttgggtgatatagagacttcgaatgtcattagaattgggaagacaaagacctctcgtatagtgtttacccgtatagtggatccagaagtttgtgggttcccctgtcaatccgatatttctattttgtatactgaaatcattattatgtttattctttgtcctatgaaatacgtctacaaggtttcgaaaccggacaaacactcaaatctaagtactcgtatatggatcctgtgtttacatataggtaacattaactaactcttattcgactgtaattgttaaatttctctgtgacgttcatcatattagtacatgtatgtatatattttataccgataaatacgacctttcctactccggttaactcctaagactataatcgaaatatttctctacacagggttaatcttctccacctctctcaacactttaaatcttaagactaaaattactatttcctttgtacacactatcttttctggtccttaacccccctttttgaaagtcactttgatgacaaaaacaacaacaacaaaaaaattgacatttgttcggtggtttgaaggatttgttttcacttgaaactcactttaatattgtaaatcggtacgtcttttgtcccgtaaaaaggtaaagatttccttattatgatttttgaatctaccgaggggttatgaaccgtttgtcactaccaattataattcacagttgaactaacctaacttcctacgtgtataacgaggacccacacagacactcacacaacggtttcctctgattgtagactcagtcacctgaccctccccgtctgggtgggagttaaacccacccgtggtatgttatttgacggtcggaccgatcttatttcgtccgtcttcttccaccttcttcggttgaacgagtcagaagaccggaagtagaaagaagggacgacctacgaaggacggaacttgtaatctgaggttcaagaagtcgaaaacttgagaacctaaatgtggtctccaaacggttcccgagagtccgaaaaccggtgtctgacttccggcgtaaacaacctaagggatgaaaactccaaaactctgaacctgaccgaaggaacgaggagtcgaacgtctgtcggataacaccctgaagtggaatggtagtacgttcagctatgaggagttattcgaggggaagtatatatgtagataagataatcaagacagggagacctcttgggattatgtgtttgattgtcatccaacaactcatcttacattttgaagactgaaaatgtcttataacaaaagtgaatcttcgacgaaatagtctttattttatcgagagagtgggatatttgagactttaaaagttgttttttacgtgtcttactgttctcgtcgttattattttaggatttgttctgttgtgagtttttatagagacacttttctaaccttattttattttatagttttgtttttttggggtgtttcgtcggtgtcttatagtgttggtcagatatcactactgtcaatagtgatactgtcaatagtaacggaaggatacaaagaaaggtagactatggttcccattgtaaagttcgtgtccattgtttgtccattgagtttaaggaaaacatgacaaaaggaagaaaaacctacaggggaccgaaagaattcatttaaattccagtgtgcgtacttgtgtctctttgtaaagaaatacgacgtttaccactggaagtgtaatagtcacagtgataatgacaccgaccagagtggaagagggtgatacccgtggataccttactaatttctgtgatctctttcagttttacctttatccctgatctaccttgaaggccgtcagtttcttcttcctaaatacacaatcacaattgtgatattcactatcacaattcctcccgttcagttcaaccttgtttcgaatcatttggtcgagatgggatattggaccagtaacgggaaaggggtgtagttcttcatgaaattattggaaaccttttacctggaactcatgttgcaagaatactatgatccaatacgttaaattatcgtggtctattggacccctctaagttgtcaaccaagatcttatgaaatcaacagagtcaacgaatgatattagaagttaaaagaagacaataacaactgtaaataaagtaaagaaatttttagaatattttctaatgtagtaacttcagagtagtacgggttgagaggtcacgataatgggagtcgaagttccatccatataacttcgataaactcttctaataatgtatcgactagggattataaatgtaaaagacataaacttttaagtgaaggaaagattttaaatcaacattaggggtttaattatgaatgtagtgaaaaagtcaataaacatttgtacgagtctcaccatttttaacactcagtagacttcacgtgtaaaggtcgactccaacttgtttcactatgagacagaaaaacaaagtagagagtatgatatttgtttatagaaaacataacagataaaggatagtacagaaagtgtaaaaacaaagaaaacaaccaccaaaatgataaaatttaacgaccgttcgtatcacgacttcacaacagatccccaggattcccgttcttaccctatccggcactcctattttatgtgcacaatctattcgaaccaagtccgtacttaatatcaccaaaacggggattagagtttcaattactttgttgttatataagtttattgcaccgaaatttgcctttgtgtgtattttgttccaatatataactgaccaactttttgcaaaacactggtctccgagtgttcttgaattgggacatgaaggagatcttctttaccaagtcataaacgatttagttacaaacgtcaccgaaatatctcgtattgatggtacttacgactctcaactgatataaacatattgtgtgctcttactttacaaagttggtttattgtcatttgaaatacggtcagaggggggttttagaatcttatcgaataaattttccaaccggcagtcgtgaattttcactttctcgatgaatgatccggggttgcacgtcatttttaatttttttattaggtaattgtagtctgattgacgtaaaagacaaaactgtacaaatgttcgatctgtctagtggttacacccaatatagtgtaaaattagagttccttcataaactgtaccagaaattaatataggaacatctgttgtgtctctatatacctaacctattattatgttaattcactcgtacattgataaatctcaagagatacaattcacaagactaattctttaataatgttttcacatttctcacaagactactacaaggtatcatgacaggactccgaaataagaagtttcgggacaggaaaggtcttaaaattgaccactgaaagtatctcttcatcattcgtacgaaatgtctcaaaccatacaattcttcgatacactcttgttctgccgtcttattgtccataggggggaatataggaaggtgttgttgttattaaacccttgataggtgtttgttttcacggaaacaccttcgaaaccctaggtccatccttcaacgttttagaaccacctcgtgttccggttcctcctggtaacactcttccgtccggacacgggtccaccttccgaacggatggtgtcaggaccgatgtctggatctttgtaacaacgggggacacctgagtcgatgtcaggacaaatcagaacctagacggtgggttaggtatacggttctttgggttctcctcagtacggatgtggtacaaaatccattatccggacgattggaaccaggacctatacctgggactttcctaggtactggacggaggtaggggagagtctacactaacccgttgtcaagacgggcgtgtacttatacgacactatgtacgggtaggtgtgggaatcttcgtccagacgatttaagtcagggtatcgtctaagactttgtcaggacattgagtcaaggtcgagaaggattgacaccagactcgtataaagacggaaaggtccataggtggtcatctgtgtaggtaaacacgatgacctccgtccaaacggttcgagtcagactgacacctagtactccgtcgtgacattgagtcaagatggggaagggttagtaccaggtcctcatcaggaagggtgagtccctaaacaacccattgtacgggtaggtacaggacccaccatccggatgattaaaacaagactgacgtctaagacttcgtcgggactctgtttctaggtccaagtgagtctattttaatcctcatcaggacggaagggtgggtcctcctacgtatggacaggtacggggacctcagtccaaacgtctggagtaagagtcgacacctgggacttcatcgggatactgaaccaaagtcgaggagagtcggtactatacaccggacaggaaggacgggtccctggaccggtcatttaactattctcgggagggttactaagtcacctttggtgtgagtaaatatggtggaccattgttcaggtgacagatttctgtgacttcacctgtgaaattggtctcgatcgagataactacttccaggacttccatcaagtcaggtatcctcgatctgtcttagatgtaatcagactctgagacaattgtctgtgtggttgacgtctggacgacccgtgggtcgttgtcggtacactgagtcgaggttctgacaaagtgacgttagatctaccgttaaggtattcgaacccctaggttgtccttttccagaaatggacggtttcggtcagtcatttctgactttctctacaaacacgtaagtttacatatctgtagttatactccgatgtacctaaaatttttttagtccgtgtgtactgtggtggtgtcctctgattatttcgaggtcattagttggggttcctttacatctatatactttatggaccgtttcctaagttttagcagtaaatttcttcgagttactctacattctactgtctatttgttgatgtgttttggtccttttgttacgtacttttttctcttcaaattatttctttatctttggaattttttcttgatttttcttcaggacttcgacttcttatgttcctttcttccttttttaagttatctctcgaagctgtcttctgcgtttgtcttatttcgaagttgtcgtctgagttcgtcagtcaagtttctgctcagtaaactttattcggtcaatcggtccacacctccgaatatggacaacagagtcgtaaaactttccgactccgtccatctagtggactccagtcatcaagttctttaatcagtcaatttccttgttttttattttttttcttattttttctcacttacagggatactctggattccctgtggtagttcacttatttttatacgtaatagtctaagattcttccaccccctcctccctccctctctctctttatcgttctttcgaatacgtttgtttatttccatcttttaagagtttagaatcctttctatatttataggtctgagtacttcgaatttctgaaagttcgttttatttgggtttcttctaatatatatctgtgtaatattagtttaacagttttcagtttctttttctgtattaaaactttcgtcgttcttttttgtctgattagagtacgttcccttagaagtattccaatagacacttaagaatcgtcttttgaacgtccggctctctcaccttattatataaattcagtactttttttttggacggttagttctgtgatactgtccttttcgacaggaagtctttacttttcttgtttatataaagaaaaaaataataataatatgaaattcaagatcccatgtacacgtgttgtacgtccaaacaatgtctccatatgtacacggtacaaccaaacgacgtgggtagttgcacagtaaatgtaatccataaagaggattacgatcgggagggggtcggagggtgggtgattgtccgagaccatacactaccaggggtgggacacaggtacacaagagcaacaagttgagggtggatactcactcttgtacaccacaaaccaaaagagaggaacactgtcaaacgaatcttactaccaaaggtcgaagtaagtacagggacgtttactgtacttgagtaggaaaaatatcgacgaatcataaggtaccacatatacacggtccaaaagaattaggtcagatagtaactacctgtaaacccaaccaaggttgacaaacgataacacttatcacgaccttatttatatgtacacgtacactggaatctcatcgtactaaatattaggaaacccatatatgggtcattaccctaacgacccagtttaccataaagatcaagatctaggaattccttagtggtgtgacagaaggtgttatcaacttgattaaatgtgagggtggttgtcacattttcgtaaggataaagaggcgtaggagaggtcgtagacaacaaaggaccgaaaaattactagtggtaagattgaccgcactctaccatagaataacaccaaaactaaacgtaaagagactactggtccctgctactcgaaaaaagtacagacaaccgacgtatttacagaagaaaactcttcacagacaagtataggaaacggatgaaaaactaccccaaaaaaaaagaacatttaaacaaattcaagaaacatctaagaccaataatcagaaaacagtctacccatctaacgtttctaaaagagggtaagacatccaacagacaagtgagactaccatcaaagaaaacgacacgtcttcgagaaatcaaattaatctagggtaaacagttaaaactgaaaataacggaaacgaaaaccacaaaatgagtacttcagaaacgggtacggatacaggacttaccataacggatccaaaagaagatcccaaaaataccacaatccagattgtaaattcagaaattaggtagaactcaattaaaaacgtataccacattcctaccctagatgaaagtcgaaagatgtataccgatcggtcaaaagggtcgtggtaaataatttatcccttaggaaaggggtaaagagcaaaaacagtcaaagtagtttctagtctaccaacatctacacaccacaataaagactccggagacaagacaaggtaacaagatatatagacaaaaccatggtaatggtacgacaaaaccaatgacatcagaatatcatatcaaacttcagtccatcgtactacggaggtcaaaacaagaaaaacgaatcctaacagaaccattacacctgagaaaaaaccaaggtatacttgaaatttcatcaaaaaaggttaagacacttctttcagtaaccatcgaactaccattaccgtaacttagatatttaatggaacccgtcataccggtaaaagtgctataactaagaaggatacgtactcgtgccttataagaaggtaaacaaacacaggagaaaataaaactactcgtcacaaaatatcaagaggaacttctccaggaagtgtagggaactttcaacctaaggatccataaaataagagaaacatcgttaacactttccctcaagtgagtactaaatcgagagacagacaatcaccacttaaaccgagagacagataattaacacatattcttacgaacactaaaaacgtgtaactaaaacataagactctgagacgacttcaacgaatagtcgaattcctctaaaacccgatctactaccccaaaagatttatatattattacagtagacgtttgtctctgttaaactgtagaagagaaggattaagttatgggaaataaagaaagagaacggactaacgggatcggtcttgaaagttgtgacacaacttatcctcaccactctctcccgtaggaccagaacacgacccaaagtctcccttacgaaggtcaaaaacgggtaagtcataccataacggacacccaaacagtatttatcgagaataataaaactctatacaaggtagttttggatcaaataactcaaaaatcgtacttcccggcaacttaaaacagtttcgggaatagacgtagataactctatttgcacctaaaacagtaaccaagacaaatacactacctaatacaaataactaaacgtatacaacttggtcggaacgtagggtccctacttcggtagaactaacacctcctattcgaaaaactacacgacgacctaagccaaacggtcataaaataactcctaaagacgtaactacaagtagtacctataaccggattttaagagacaaaaacaaaacagtcacggtccgaaacgataatcctactacgaccggagtattttactcaatccctcctaagggagaaaaagataaatagccttatcaaagccttccttaccatcgtcgaggagaaaaatggagaccatcttaaaccgacacttagacagaccaggacctgaaaaaacaaccatccgataattaataacggagtcaaaatcttggacaataaccagataagtctataagttgaagaaagaacaaatcagaaccctccaacatacaccggtccttaaataggtaaagaagatccaaaagatcaaataaacgtatctccacaaatgtcataagagactaccatcaaacataaagacaccctagtcaccactataggggaaatagtaaagaataacacagataaactaagaagagaaaacttccaaaaaaaaaaattagaggaaaccaagacgagacaagaatcaataaatagcggaagacgatcgaaacttaaacaaacgagaacgaagagaacaaggaaattaacactacaatcccacaactaaaatctagaaaggacgaaagagaacacccgtaaatcacgacatttaaagggagatgtgtgacgaaatttacacagagtctctaagaccatgcaacacagaaacaagagtaaccaaagtttcttgtataaataaagacagaagtaaagtaatacatggatcgtaagtaagtcctcgtccaacaagtcaaagatacatcaacacaccaaaactcactcaaaaaattaggactcaagattaaactaacgtgacaccagactctctgacaaacaccactaaagaaaagaaaatgtaaacgactcctcacgaaatgaaggttaatacaccagttaaaatcttattcacgctacaccacgattcttcttacgtataagacaactcaaaaccacctctcaaaacatctacagataatccagacggaccacgtctcgacccaagtccaaaacctataggaaaaattggaagacagagtaactagacagattataactgtcaccccacaatttcagagggtaataataacacaccctcagattcagagaaacatccagagattcctgaacgaaatacttagacccacgaggacataacccacgtatatataaatcctatcaatcgagagtaacaactgaactagggaaatggtaatacattaccggaagaaacagagaaaagtagaaacaaccaaattataaggcaaaagtagtctctgatcctaacgttggggatgaaaaacaacgaagggtaaacgaaccatctagaaggaggtagggaaataaaactcggatacacgtagagacgtgcactctacccagaggacttatgtcgtgtgactacccagaactgaaaaataggttcaactgtcagagacataaaattaaccccgtaaatcgggtaaatgtaaattccaattataacaatacaaacttaaactagaacggtaatactacaatcgaccaataaaacgggtaattaactacgtcaaagaagtatcatagttaccagaaatgttaaaccgtacaaaaacgtgaccgaccatggccaaaaaggaaaggtacaaatcacgaaggaagtcctcgagaacattccgtgcagaccaccactgttttagacagtcgtaaacgaacagacatttcctaaaataaagaggaagggaattcttccaatcacaccgacctatactttaagaaccaacttttaagaaaagaaattcctacaacttataaccgggggtgagagaagaccgaacatcccaaagacatctatataggtgacaatcagactacccaaaggaaaacacccattgggctgaaaagagagaccgaaacgaattgtaaaaaaggaagtaaagttggaaccacttagactgttaatacacagaacccaaacgagaagagctcctcatcgaaacaccacaagacacaaaaaggacttaaacttacaaccggacggaacgatacaaccccttcaagaagaccgaatattaggacttatcacaaaaggttgaaccaaggtaagaggggcagtgaaagtccatgtggttagtttgtatccaaaccagaaaagtgtatcagggtataaagaacctccgaaacagacaaagaaaaatgagaaaaaagagatttgaacagaagaacgaaataaagtaattaaactagaagttagtgactatggtaaagaagatgaactaacttagccgataacttcgaacacgtaggtagtgcttcaagaacacggtaccaaaagtcgaggtagtccagtaaattccagaagagatgtgacaaataagatcaaccggtaagcagattggaaaaagagttccaaaaaacgaaggaaggttacccgatcttgtaagaggaaatccagtcttttcaaacaataatgactggaagacttccgatgaaaacagttgagcagtttcagtaagaggtatgtcgaaacaaggtaacgaccgctcctcaacgctaggaaacctcctcttttccgtgagaacaaaaatcttaaaagtcgaaaagacgagaccaaagagtggcagaaacaccaaaatagatggaaaccagaaaaaaaaatacgttctcgttaaatttttttaatttataaataaacttattgttcaaattcaagctcgacgttacaaccgttacgtccaaaaattgtgtctagtgtttttcgtacgtgttttttcatgaccgcgtttcctgttttatcacgattcttaatccggtttatcgatgactaaaattcttttattttccggactttagtgatatgttttatattttacataatttgtgatggtaggtgtcttgtcagaaataataagtaatataaatttttaataaacgtattaatatataacttaacatttactcataatatgtacttggaggtaaaccttccgttaaggaacatcgtgatatcttgtagattaatgtaacgtttttcataggaaaaaacgatagctattttgtcaattagcataatgacatttatagtccttccgatgtttttttctatattctaaaaaaacagaagttttacaaaaggtacgtcacttcgtgaacgacacaacttgacttacgtgatgacctcttacaagacctaggctctacgagaactctctgttctgatccgaaaagtttagtttgtgagtttccttagtacgttgggagaatactgaccctatggtagtacacggtgaatggttacgacagagaggtcttttggtaagttctacgaattatttttttagtctgaatgaactatttatatgtattttacttctgtggttgacgctaaactgtactgatgaccattacagacacgatacactttcgtggaaatttttctcggatacgccgttctctattcacagatttctaagttttacttagttgtcgtaacctattgttatattaagagttaagtcttcgacggagttctaatccacgtagaagtcaattacattgtcctttttttccgtcacctaaaataaaataattaacataggtgaatgtttgactggattccagtggggctacacatctgtgttactctaaaaacaacaaatatcagaaatcaacttcactattccctttatctagataaatttttgttttggtttgtcgataaagacagatctaattctacaccggggcccacactctaagtgtaaaactcaccggtgaacaccacgttggaactactagaccccaaacagatactaagaccgacacaccaacgggaagagatgttagggttattaggtacgaaccaccggaagtgatataaaccccctgaaatagagacgtgtcttggctcgacgaacgactgtaccatttgtctagtcttccggcggactccagaggcccgtccagggtacgtactccgacttgtacaaaggcgtccggaacgagtggcgtcggtagaaccggtcgtggtcctccaacacttaatgtttgctgtggagcaaggagacgacgaaccgatccaagacgtgcaccgggttttagggcttcgggcactacagtcaccggtacacccgtaacttgcacacgtactcaggacgtcgacaggacaactcggagtggtacaagtagtagcggaggaccaaccggtcgagatgtagaagccactggtgatcgaattagaataaggtaaagattccttataggtcggtgaccacgtgtcggtgacggtggacacaggggtccccaaaacagttgtggtcgtgcaggggaccgtgacgtaacagaccgtactatttaagtaacccgaccttctgtcaccatcactgaggagggtcctgttaggtccctaaatcatgacaaaccgactggtaatgtctgtaaggacgaaggagtcgacgtagaaattttgaaacctattagtctccgtagtgaaatagggaaagggacagccagtaaaataatgactgaggttcctcgtagtcgtataacagtgtaagacactgggggtaacgtatctccagtgactcctgtaaccgtgtacgataggacgggtagtacattcccagcagatgctagcccatttacattagacaccaaacttggttcctttcgggtggtacggagtttccttaccgtgttcataggtaaggttacgcttcggaaccgtattgccgagggtctttgacgagtagaagaaccttcaccaagaggacatttctaaggtcgttaaaaacgttctgtagaaccccgtgaaacgttggacacgggaagtcaagtcacttagaccaatcggtcttcgaaaacaggttaagtattgaaaggtccaatttcctgagggcgaatctgtaccaagaacccggggcgagaggagtgtcgagtcggggaggggagggagacacccaaccgacccaagaaatacctaggtggccgaccgaaacgtgggaggcggaggagggtttttgcccgacgcccggcgagggtgttacgtggcccgtgccggcctgagggaattcgcagcggacttatttttacggtgcggaccaccgtcatcgtcaccgtcgggtccgggtacggacccacgacgcccccgagtggaccgaaccgtatcgggacaccctcggtccggtaccgtgagtacggacgacccgtacaccccgatgcaaaccagaaactacaaccaatagatgtctaccccaaaaatacacctacaggaaaaacaactataactacaataaagaaagacaaacgatcaaaaggaagattgtcagtccagggagtcgacgtccagacaacctcaaaagacctccaggtaggtcgggcaaacggacccatagtggtcgtctccgacgtcttgtcatctataacgtcttgtggtgtataacgagggactaaaaaggagaccttcgaagcagggtctcccttcggcggatatactacacagataaccggggatgaccctccacagagggtcaatccgatgtggcgtcagtccctgggtgtactcctccgtcagacagacaagagtctcgagtttacggtatgaccctcttggtgacgagagaagtcaagacagtctgtccctacaaattcaaacgtcttcaacagacgacggaaaacaaatcgatgcgggacgggtgtctccacctaagatatttccgtcatccggaacgactcgacaccacccgaggtgggtcaaactcgaagggcctgtgaaacaaatggatcatttcggagtcgttaccgtccacggggagggggtcgttccgacgtcggaacgtccagctagagtttgacgacgtgatcgtcactcgttccgaggtacacacaccctgagtggctcggtccgtgccctctcttagaggatctgacggccaacgattctgacaccctttttacgtcataaacccaccctcacagggcaaaaaggtccatgtcagacagtgccgaagggaaccgatcctttccctttaagggactggggaacgtgaagggtcaattccactacggggtgggacgaagccgagtgggaggtacccgacgtgagtgacaggttagtccgggtcactctacttggtcaatggagtcgacctttacgtctttagtgggttgaagacgtagttactgtgaccctcgacgtctgacctcgacaaggataagccggtagaagtcggtagccagtttaaacagtaaaatattcatagggtaagggtgttgttacttgtgtgaaggtactattgtcgtaattagtaaatactccaaccacagggtactgggtttttgatgggtagtccgggagttaggaaataacatctcaaaaatatacaccaaattcaatccaacgaaagtcgaattttatctgacaatattggaattctacaaaatatattcggactaccattgttgtttttcttttcgagatcatctatgtattttctatttctctttctttatttttgtatggtgatgttttttttagtaatttcatacttccttctgtcgttctctccttatttcattgtttctttgatgtttgtattttgttacgattttaactgttatttcggtcgttgccactgtgtacagacaccagggtcgatgactcctcctactccacactcctaacgaactccaattatcacaccccgacatcacacgatactaacacggataattatcgacgacgttaagtcggacctgttgtatcgttctgtcacaagaggtttttatttatttatttttaaattttacggttatcaaaaaatttaatgagagggtgaacgtttctgttttgttacacatctctaaatgtgatacttgtaaaaaaaaagggttcttcgttgtgtctttgaattttccttttcactttctttggtgtatgggaaactttcttcacaacccgacgtcggatgtgacactcggtccgtcttttgattcagggtcttacactctccccctatttgacggaggtcctatgtgtgagggtgacccttgggtcgttaagtccggtgtcccctacttgaattgagatggtcgtgaccttgaataaatcactgaccacccctcatataatattcatcgtctttgtcctgcacggaacgtacgtaaaggtaagaggtcgtctctacctcccttcggtaaggactaggatggagtgtgtcctggagtgtcttcagacggtcgattgagttcatcacaagtgtccaactctcttcgagggttgactcgaagtactatattaggtcttggctcccccgttcatccttcatttgacatctgtacccaagtcctcgaccaacagggacgaaacacccgtctgaccctttctatatcggggtatcgatgtcaaatacagagggaccccttccgaataccggatcccgtcaaaactcaaaacttccgtctgacagatcttagatcgatcgacgacgatcgccttattacaaccacactccggacgaaacgattcacgtaccctcgatccaccccgaatcgaatgacgacggacgattagagataaggggtatacctaagaaggcacgtcgtctctgtcgacatcagaagggaccttgtaattggaccaccggtcttttgataggaggtttggtgatcccggtgacgaccgtgagtgtacacctctcggtctcacaaactgaacagactgggtcgggggtgtatcgaaacggggaggtggatgggaccatagaattgtgtttcctttcttttaaaactcttcagataccgggacgagtaacggactctatggtctcatggaggggacccattattttccgttcatgtttagggtgacgatggtgtcgtcgaccacgagaaaacgttcacggtggaggaccgacctccggttggttgtatcaggtaatgtcgtggacgtccgtcttattgtgtcgtggatcgttcctcttttgaacccgtacaagattcgatagtagtaacggacgtagtgagaccgattcatcctccaggactcagacaggtacactggtcaaataatgataatatcgaacgtcaactctttcggttgtgagattcagataaatattggttccttagagtgtctcagatatagtgaggggacggtgggggtagtctcgactacgaccatgggcgacgaccctctgaaacatactaccgaccctctccagtatagtgatctagggaacatctgtaagaggtcgtggtcgtaccgtataccttaggggtgacttgtcgatctgagtctcctcgtcgtcgtaagtgacattagactgggagtccctgaggacgaggaccttctttcgcccctcacttggggtagttctctcgtgggacaaactgttttattaggtcttccgttcggaactcagggacttgaaagacgaacacccttcaaagatagtcgtctccgtgttcacgtcctgactcgagtcacacctttcaatacaccgagatggtgctatcagaccgtcgggaccatgaacacttcccagaacctcttcccctgaaagagaaggggaatgaatcgtgacgtctgtgtcgacgtcgaagagggtacccttgaatcgtacccacttgtacatttgtcggaaggacttcgtgaagtcccactatcgtagggggtttttcctcacggaacgtccaagtccgaacgtgatcatctcggtggtagggagagatgtaatttgtattcgtaaggacgtctaattttctccatggacagactagacttatcgtccttgtgacacagtcctcacactgaccctccgtctaacaaaagaacgaccggaccgtcccctcgttctaccgaaagaaggaagagggtactttcctggaaccacacaaagtgactctcgagggggtcggtggagacagttccaacccaacagacgggtgatgacccataacacaaatggatggacgaaatcggtgtcggtcaaaagtggacatctgtggtaggggatgacgggacttctgacttgataagttggatcatttattttatgactctttttttatttagttattttttcatgtgtggtgacccctatttcttcaaagtttactggagacgataaagttgggatgtcctctgtcatttggacgagtgtgtaactcttataacgatgatgttggtcgtagactcattcgttactgcatttctgagagatattggttccttgagtatggtttagaaatggaggttgtgagtctcggtttaatccaatgttatttgatattagtcggtccacaccaccgagtgtggacattaggatcgtgaaaccctccgactccacccacctagtgttctagtcctctagttctggtaggaccgattgtaccactttggggtagagatgatttttatgtttttttaatcgacccgcaccactgctcgcggacatcagggtcgatgagtcctccgattccttcctcttaccgtacttgggtcctccatctcgaacgtcactcgactctatcgtggtgacgtgaggtcggacccactgtctcgctctgaggtagagtttatttatttatttatttattatttgatattagtaatttcagtgtgggagtttcccatttttcctttatttttggtgtcatcttaatttttcattaatcttctttatcagatggatttactctaccttagtctttttattaagacctttatactgttttgtccaagatatcgaggggggtttctagtacgatcgagaggtcgttacctaggtttggttctgtttttagagactttatggtctatttcttaagttttccaaccaaaaattcaatgagttcctctgtgttctctttccaccttcatttggatttctttcaattttttcaagttttatgtttattttaaaaaattttctttatctatataaaaaaattttttagtcttgaaaacctttaccttatatgtaaaacttttgatgttttacgtcacctaaattgttatctgatgtggttcatcttctttattaaagtctcgaacttctgttccgaaaacttaattgagttagtctgtttttaattcttccttcttataccccccaccccggttctactggttgatcttcgtcaccactggcctccgacagtaccttttctaggttttgccaaacgtttagaacgtggtcgttgactccataggtccaagacagtaatcctgactgttccatcgaccgtactgggtacctttccttccttctcgacgtgtctaacaggttgtcggtgaccccatcttagtcagattcggactacccaaggaccaccctccccgtcggtagtggtgacgacaccgacggacgacagattcggtagactcgaggaacttcctccccgtcgtcggttgtgtcgtcgacgtcccggagggacatctttgaggttgaggtcggtccccgagtccctctcttaagaatagagggacccggactcggggagccccctttacattagtgtcagagacggttggtcgtctgagtcagaaaggaggacgatggacactccttagacccgtcgtgtctgctcacccaaagggacggtgcgtcgtgtgggggaggtaattccctttcggtttacccaggacgaagggtaaggtgggttgacccattctggggggaaacgtccctgtacctacttcgaccttcggtagtagtaattgtttgattgtgtccttgtttttttgtttgtgacgtacaagagtgagtattcaccctcaacttgttactcttacgtttctgtgtccctccttttgctgtgtgtggccccggtcagtcccccaccccccacttcccttgttctcgtaattctgtttatcgattacgtacgtcccgagttttggatccactgcccaactatctacgtcgtttagtggtaccgtgtgtacatggatacattgtttggatgtgcaagacgtgaacataggaatttgaatttcattttttttttttttgttttttgggtattaggtagtgtatttgtcttgattactgtttttggtgtactgttaaagtcatctacgtcttttccggaaactattttaaggtgtagggaagtacaatttacgggagagagtggtgaggataagttgtatcataaccttcaagaccggtccccttaatccgttctctttctttatttcccataggtttatcctctatccttcagtttaacagagacaaacgtctattgtattaagatataaatcttttggggtagtaacgtcgggtttttgaaattcgactattcgttgaagtcgtttcagagtcctatattttagttacacgtttttagtgttcgtaaagatatttggttgtaatctgttcgtctcttagtttagtacttacttgagaataagtgttaacgatgtttctcttattttatggatctttatgtcgattgttccctacactttctggagaagttcctcttgatactttggtgacgagttcctttattctcttctttttttgtttaccttttcgtaaggtaagagtacctatcttttttaactatagtatttttaccggtatgacggatttcattaaatgtctaagttacaataaaagtagtttgatggtaactgtaagaagtgtcttaatcttttttgatgaaatttaaagtataccttggttttttctcggacgtatcggtgctgttaggattcgtctttcttgtttcgacctccgtagtacgatggactgaagtttgatatgacgttcggatgtcattggtcttgtcgtaccatggtcatggttttatctgtatatctggttacctttttttgtctttggagtctttattgtggtgtgtagatgttggtagactagaaactgtttggcttgttttcggtacccccttccgtaaggaataaattattcaccacgacccttttgaccgatcggtatacgtctttt

SEQ ID NO: 38 - DNA, 13001 bp, Homo sapien
tgttaatgtcagcttattctcaatcaattacaatggatatacatttgtgtcctaggtatatgctcatgaatctaaactcacaaacaggccaaagctttggaacatctgcataaagtatcctgtttcttatttgtattattactaaagtcatatgttttatctttatagcctaactgtccccttgggtgtttgaagacctaggtgatatgcccatttgtgatatgctctccagaaacagaagggttaagattactgtaagcttcagagatatagtgggtttgttctttggaatttggggaaatagaaaactcttatatttcattaaaaggtactcagaaatattttctgctggttggttgatgattcttagagcttaatggtattccttcctgttccctcctcctccttcatcaagttctagagaagaatatgtctcctttctctaaactttctagactcctgaacttttatctaccaagccctagcatgccacattaatacagaaatcagtacctgagtggcaatcgtgcatagccattgtcgacaaaaagagtcaaactctgtaaaatatttgaagagatttattctgagccaaatatgagtgaccatggcccatgacacagccctcaggaggtcctgagaacatgtgcccaaggtggttggggtacaacttattttatacattttaagaaggcatgagacatcaatcaaatacatttaagaaatacattggtttggtccagaaaggtgggacaattcaaagccatggtggggattccaggctatagataaatttaaacattttctggttgacaattggttgagtttatctaaggacctgggattatagaaaggaaatgttcaggttaagataaaagattgtggagaccaaggttcttttgaagtctaatagtggctgcccttagagacaatagatgacaaatgtttcctattcagatctttaaaaggtgctagacttttagttaatctctttaggattgggaaggcctggaagaataagatctagctatgttaatagagattctttacagatgcaaatttttccccacaaagaacagctttgcaaggccatttcaagatatggcaaagaagcatgttttggagtaaaatattttaattttcttccttgtcttgtaatgttatgccagagtcagattggaaagtaagtcacgatatatataaggttaaataaaacccatccgatgacaatttatgatttgtagggcatgacttcccagaccccttagataggaatttggacaagatgaaaaaatcagaatttagtcctcatcatgtatctttctcaaaaataatagattgatgggaacagatatttggggaccaaagaagccaaagtggttcccatccctttctctctgtaacttaacctctgtgacttggcaagccttcatgttctaggctataaagcggtaagggcaagagagaaaaaaataatagttgagtaccttttataggacatctctgttgtagatagcttttaaatattaaggttaagaacattgctctcactcttcctctgacccccccccaccaactcttttactttccagtttccaccattttgtgtagcccctcctagatttctcagttaatcatggagaatagaacaaggaagccactttcactctgcatttcatgaaaaagatatttctgcagcctgattctcatttacaaagtagcacctacaactatacattttttattccattaagcatttattttcaaaatttaaaccagtactgagaggcattaaacatgtaaattatttctctccatttaagaaatgatttggcaatgcatctaaagaaccatgaaaacatttataccacttgacataataatcaaagttctaaggaaagaaaaggctagaatgcaaaggtgttcattatagatctatggaaaaatcaaaagcagcctaacagttaaacaatcaaagatgatacatgctttatctcatttccacaaataccctttatcccatctgcaaattagactcacaggagcaaactcactctgtctcatctatcagtgtccagtactatataaaaacacaattcctttataaggcttttaactccagatatttatcagaggtcacatccaagtcatgaagggtcaagctctgccaatctccatgaagctctatactcttgagtgttagccagggaacagttgactagccactgcaggttagaagtttttctgaggtattcaaagcccaaatcactcacagaaaaagaatctgatttcagcctctccttcctctttcatatatatccccacactaagaagtactaagtagagtggagtttgagaaactgaacactccttactctagcccttgaggagtttataactataaaatttgtggcaaacataagctcagtctgagtccacaatatgacattcgtaaaattctaactttgtgattcttcttcaataaactcatttgtcatttttaatatcgtatttctctggctttggtcagaactttagcagagtgcagaagtacaatataattttctaaatatattttaagatattgaataaaagccaggcatggtggcccacacctgtaaacccagcattttgggaggccaaggcaggtggatcacttcaggtcaggagttcaagaccagcctggccaacatgatgaaaccccatttctaccaaaaatacaaaaattagccaggtgtggtggtgggtgcctgtaatcccagctactcaggaggctgaggcttaagaatcgcttgaacctgtgaagcagaggttgcagtgagccaagatcgtgccactgcactccagcctgggtgacacagtgagattctgtctcaaaaaaaaaaaaagatattgaataaaaagttattcaaccttgttattaaagtcacatattacaatcttatagcctgaccatccccctgggtgttgctaaacatgaaggctcctcccttcaggacttcacaaacacaatcttattgaaataactgaaagcttctgcttttgatatgagcagcagaggatcctggagattgatggttgtaagaggttatgtaagtttcacacagcattgggttaggtgtcagacttggatttgaaactatattttgtcacttattatctggatggtcttaggcacattgacttttttcattttttaattgtttttatatttgctggtttattataaaggatactacaaaggatatagatgaagagatgtgtaggatgaggtatagggaaagaggtatagagcttccatgccctccctgggtgtgccactctccaggaacctccatatgttcagctatccagaagctctttgaaccatgtcctcttgggtttttacataggcttcattacagaggcatggttgattaaaccattggccattggtaatcaacttgaccttcagcctctcttccctctccagagtttgggggatggggttgaaagcccaaccctctaatcatgcctttgtctttctggtgaccagccctaccctgaaggtgtcagtcaacattaccatataaaaagacagcactttggcgattccaagggttttaggagttatatgccaggaaactgggatgaagaccaaatatatattttaaaatatcacagtccacccctggtatttgaacctggatcctttacatcaaaagggcatgcaactcaaaagatattgaatcccattcagtcattaataattggtccaatccatcatcttgcattaatgtgtcccagggtgaggccactcaggtttacaggcttccttttaatcttgtcaggttccaaaagcagttgttgtctcagcaaacatataacttcacactttcaggcatctggaataactgggctaagaggcagtgtcatctcttgctgtctcttttgaagtatttatgtaatgtttaatttctctcaatttttaacccatttatttactcaaactcacttttggaagggatgttagaaacaccactgtgctggattgcaggcagcaatactagtctagcaagtgcctcctcctcagtctactcccattccaataaggtaaggttacataggtacagaactagtgggctatttttaccaccaggcaatatagctatatacattcactattagcctccattttgccaaatgtggaagcacaatccacccctagaagccttttaggaattctaacatagaggtttaaaggtaaagttttttgcttaaaaagcattcctgctattagtaggagttataattggagccctggtcctaggaccaccacatcaggtaagggagagaaaaaaatttgaggcaatttggagaagaacaaaaattatagtagttataccagtatactcctcctttggtaagaattgcagttttaccagcatcctccccagatcaaccagaaagacagattaaaaaaaaaatctaggccaggcgcgttggctcacgcctgtaatcccagcactttgggaggccgaggcgggtggatcacgaggtcaggagattgagaccatcctggctaacacggtgaaacctcgtctctactaaaaatacaaaaaaaaaaaaattagccaggcgtggtggcgggcacctgtagtcccagctactcgggaggctgaggcaggagaatggcatgaacccgggaggtggagcttgcagtgagctgagatagcaccactgcactccagcctcagtgacagagcgagactccctctcaaaaaaaaaaaaaaatctagtcctacttatgtactgtgagcacacacttgtgaaggatataagcaagcccttcatatctatttctcccccaatttagaaaaccaatatttcaattgctccttccttttggttccatatgaaattttaaagtagttttttctaattctgtgaagaaagtcaatggtagctttataagaatagcattgaatctataaattattttgggcactatagccattttcacgatattgattcttcctattcatgagcatggaatgtttttccatttgtttgtgtcctctcttattttcttcagtagtggtttgtagttctccttgaagaggtccttcacgtcccttgtgagttgtattctaggtattttattctctttgtagcagttgtgaatgggagttcactcatgatttggctctctgtttgtctattattgctgtataggaatgcttgtgatttttgcacattgattttgtatcctgagacttgcagcttaagaagattttgggctgagacgatggggttttctaaatacacaatcatgtcatctgcaagcagagacaatttgacttcctctcttcctgtttgcataccctttatttctttctcttgcctgattgccctggccagaacttccaatattatggtaaataggagtggtgagagaggtcttccttgtcttgtgccagttatcaaagggaatgcttccagcttttgcacacacagtatgatattggctgtgagtctgtcataaatagctcttatttatttaaggtatgttccatcaatacctagtttattgagtgtttttagcatgaagggtgttgaattttatcgaaggccttttctgtatctgttgagataatcatgtggtttttgtcatttgttctgtttatgtgatggattacgtttattgatttgtgtatgttgaaccagtcttgcatcccacggatgacaccaacttgatcgtggtggataatctttttggtgagctgctggatttggtttcccattattttattgaggatttttgcattaatgttcatcagggatattggcctgaaattttttttacattgtgtttctgccaggttttggtatcacagtgatgctggtctcataaaatgagttagggaggagtccctctttttctgttgtttggaatgatttcagaaggaatggtaccagctcctctttgtacctctggtagaatttggctgcgaatccatctggtcctgggctatttttggttggtaggctattaattactgcctcaattttagaacttgttatttgtttattcagggatttgatgtcttcttgcttcagtcttgagagggtgcatgtgtccaggaatttatctatttcttctagattttctaatttatttgcatagaggtgtttatagtattctctgatggtagttggtatttctgtgggatcagtggtgatatcccctttattattttttattgtgcctatttgattcttctctcttttcttatttgtcttactagtggtctatgtattttgttaaaatttccaaaaaactagctcctgaattcattaattttttgaaaggttttttatgtccctatctccttcagttctactctgatcttagttatttcttgccttctgctagcttttgaatttgtttgctcttgcttctctagttcttttaattgtgatgttagagtattgattttaaatctttcctgctttctgatgtgagcatttcatgctataaattttcctcttaacactgctttagctgtgtcccagagattcaggtacattgtctcttttttctcattttcaaagaacttatttatttcttccttaacttcattatttacctagtagtcattcaagagaaggttgttcagtttccatgtagttgtgtggatttgaacgagtttctgaatcctgagttctaatttgattgcactgtggtctgagagactgttatgatatctgttcttttgcgtttgctgaggagtgttttacttccaactatgtggtcaactttagaataagtgccatgtggtgctgagaagaacatatattctgttgatttttgttggagagttctgtagaggtctattagttctgcttggtccaaagctgagttcaagtcctgaatatccttgttaattttctgtctcattgatctgtttaatattgacagtggggtgttaaaatctcccactattatcatgtgggagtctaagtctctttgtgggtctgtaagaacttgttttatgaatctgggtgctcctgtattgggtgcatatatatttgggataattagctcttctcgttgaattgatccctttaccattatgtatgtccttctttgtctcttttgatatttgttgatttaaattctgttttatcagaggctaggattgcaacccatggttttctttttttgtttgttttttgttttgttttgttttctattttcttggtaaatattcctccatccctttattttgagcctatgtgtgtctttgcacatgagatgggtctcctgaatacagcacactgatggcttttgactctttatccaatttgttagtctatgtcttttaattggggcacttagcctgtttacatttaaggttaatattgttatatgtgaatttgatcctgtcatcatgatgccagctagttattttgcacattagttgatgcagtttcttcatagtgttgttggtctttatattttggtatgtttttacagtgactggtacccatttttcctttccatatttagtgcttttttcaggagctcttgtaaggcaggcctggtggtgacaaaatccctcagcatttgcttgtctgtagagaattttatttctccttcgcttatgaagcttagttttagctggatatgaaattctgggttgaaaattatttgctttaagaatgttggatattggcccccgctctcttctggcttgtagggtatgtacagaaagatccactgttagtctgatggacttccttttgtaagtaacctgacctttctctctggctgcccttaacatttttttcttcatttcaaccttggtgaatctgatgattatgtgtcgtaaggttgctcttctcgaggagtatcagccagtctggtagaatgaataaaagccactataaggtctgtttaccctgagaaggggactgcccaactctccctataaaatgccaagtggcgcaccctacatgaagcagctgatatgcttcatatgcaagtcatgttggactggctttaccatgatattcgcccactgaatatgcccattacccagaccatggtaaatgctacggttcaaagggacccttctacatgggtatcctgggtgccattactcctacagaatcaaacaatggttcaagaagccttatcaaatatgctgttgcagcttttcctcatgagtcttacaggtgctaataaaacataaggataattaaccaaaaaaaatgagaaaggcaaaaggggagtcaaaggactcatcttagaagggtagaaatctttagatggttattaagaaatgaaatagccaggcacagggctcattcctataatcccagcactttgggtgaccgaggcaggcagatcacttgaggtcaggagttcaagaccagcctggccaacatggtcaaaccccatctttatgaaaaatacaaaaattagccgaatgtggtggcatgtgcctgtaagagtatgaattcccctggagtctgtggtttccaagggctctatgcactcatgctagcccacacttggcctttagatgtttaacttttaatcgaattcctcatacttgcttatatggaggccttatcttcccattgacacaggtgagccagtgttcatgttctgtcttttcttgaaaaagtccatctttccttagagttcaggctagttagttgccctgcaccctcagctcttcaataaattcaaggtttgttttgatttttttgagacagagtctcactctgtcacctaggctggagtgcaatggcatgatcttggctcaccacaactgcagcctcccaggttcaagcaattctcctacctcagcctcctgagtaactgggactacaggcacatgccaccacacccaactaatttttgtatttttagtagagataggatttcaccatgctggccaggctggtcttgaactcctagacctcaggtgatctgcccaccttggccacccaaagtgctaggattacaggtgtgagccaccatgcctggcctcaagttatgattttttagtttatcggtatttttcttattgttatgtggaggacactgcgtttgccaggttttttgtttttgtttttgtttttgttttttgagatggagtattgctctgtcgcccaggctggaggacagtgatgcgatcttggctcgctgcaatctctgcctcccaggttcaaatgattctcctgcctcagcctcccaagtagctgggattacagttgcatgacaccacacctggctaatttttgtatttttagtagagtcagagtttcaccgtgttggtcaggctgatctcaaactcctgacctcaggtgatccacccaccttggcctcccaaaatgctgggattacaggcatgagccaccacgcccggctgcctttgccagttttctacatcctatgtggaacccagaaatccctgatgtccatttgtgttgtagttatctagttttttttctagttgttacagtgggaataatggtctttcactatcttctacattctgacccaaagccaaatgtcataataacctttctgaaacataaattggatcataacactcctttgctttctatccttcagtggtttctaatcatacatcaaactttaaaaataataaaattcaaaatttttcttttgcttgtaatatcctgcatgatcttgggtctttttgctgtcttttttttctatcttttcaaacacatctcatgccattctccttattttctatactccagccaaggagttggcaatcttttcttataaagggcctgatactcattattttaggcttttgggccacatggtctctgttgcaactacaactcttctgttgaagcacgaagcagctatagacaatatataaatgcattagctttgctgtattccaataaaactttattaatggacattgaaatttgaatttaatatattttttgtttgtcatgaaatattctataatttttttcttccaaccatttaaaaatgtaaaagatcagctgggtgtggtggctcacacctgtaatcccagcactttgggaggctgaggtgggtggatcacgagatcaggaattcaagaccagcgtggccaacatggtgaaaccctgtctctactaaaaatacaaaaattagctgagcatgatggtgcacactgtaatcccagctactcagcaggctgtggcaggagaatcacttgaacccaggaggtagaggttgcagtgagccgagatcgcgccagtgcactccatcctgggcaacagaacaagactccaactcgaaaaaaaaatcaataaaaatgtaaaagatcattcttagcttggaggctataaaaaaggatgcagcatgtcagatttggcccattagctgcagtttcctgacctctatctacctcaattggttctttacttacattacatggaaagtgcaaacttggatggcttcaatgtctggcttcttttatttatttatttatttatttatttatttatttatttattttttgagacggggtctcgctgtggcccgggctggagtgcagtggcacgatctctgctcactgcaagctccacctcctgggttcacaccattctcctgcctcagcctcccgaatagctggaactacaggtgcacgccaccacgcttggctaattttttatatttttagtagagacggggtttcactgtgttagttagccaggatggtctcgatctcctgacctcatgatccgcccatctcggcctcccaaagtgctgggattacaggtgtgagccaccgtgcccggctggctggcttctttttacccttcacatctggctttaaatactaccttttcacagatttcttctctaatcactctttctaaagtaaatatgctgtttttcattattagtcattgcatcctatttctttccctttaattttcttatcacaatgtataattatatgtttttttttttttttggttattgcctgtctccctcaatagatcataagttccatttgataaggtacaatgtctgttggtttattagccagtgcctaacactaccatttaatatgtattcaatgaatatttgttaaatgtattgattgaatttaaagtgactactcagcctacttctgccccttggagcttggattgtttcttcaaaggtattgatccttttgactattttaattatgaattcactaaagacatctggaaggcttattgtgtcaagcagtgccaaatccatggcttgatgaacctagatccatccccttcccctttccatatcacagatgacaacttgatggttggcctatgacttgtaaaagttgtcatatttgaattctgaaatttctctaattttcttgggaagcagaaaggaaaaattagtagttggcctcaaagggacagttgaatttcacatataatgagcaaagtagtgtgaggaagagaggagggccttttcttttgaggtcataactaaaagttaggtgagcaaatgccataagcatgaaaatagcaaaccaagcttcttggtttctatccaaaggctttgttgggaaaagtatcaaagtgtgttcatttgttatgtaatatataaggtagagaacccaatttgaaggaggtggaataactttccaaaatacttatggctaaattctcagttgatcttggaataagattcaagaatccaaatgcacccttctttgttatcttgctagaaaacatgctgggcatggtggctcatgcctgtaatcccaacacgttgagaggccgaggtgggcagatcacgagatcaggagttggagaccagcctgatcaacatggtgaagccccgtctctactaaaaatacaaaaattagccagacatagtggcacgcacctataatccgtgctactcaggaggtaggcaggagaattgctggaacccgggaggtggagtttgcagtgagccaagatcacaccactgcaatccagcctgggtgacagagcgagactctgtctcaaaaaaaaaagaaaagaaaaaagaaaagaaagaaaaaagggaagggaaggaaaggggggaggggagggaagggaagggaagggaaggtaagggaagggaagggaagggaagggaaaagggaaaacaatgtgcttttacccacagctgataagcttttctaattgtctacctttgggttaaactttatcattgagtgtttttatcccattatgaaagaattaaggtttgaaggactgaggtaagggtggatatttactcttaattgagtagcttaaccaagtcaagccacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcaca

SEQ ID NO: 39 - DNA, 130001 bp, Homo sapien
tgttaatgtcagcttattctcaatcaattacaatggatatacatttgtgtcctaggtatatgctcatgaatctaaactcacaaacaggccaaagctttggaacatctgcataaagtatcctgtttcttatttgtattattactaaagtcatatgttttatctttatagcctaactgtccccttgggtgtttgaagacctaggtgatatgcccatttgtgatatgctctccagaaacagaagggttaagattactgtaagcttcagagatatagtgggtttgttctttggaatttggggaaatagaaaactcttatatttcattaaaaggtactcagaaatattttctgctggttggttgatgattcttagagcttaatggtattccttcctgttccctcctcctccttcatcaagttctagagaagaatatgtctcctttctctaaactttctagactcctgaacttttatctaccaagccctagcatgccacattaatacagaaatcagtacctgagtggcaatcgtgcatagccattgtcgacaaaaagagtcaaactctgtaaaatatttgaagagatttattctgagccaaatatgagtgaccatggcccatgacacagccctcaggaggtcctgagaacatgtgcccaaggtggttggggtacaacttattttatacattttaagaaggcatgagacatcaatcaaatacatttaagaaatacattggtttggtccagaaaggtgggacaattcaaagccatggtggggattccaggctatagataaatttaaacattttctggttgacaattggttgagtttatctaaggacctgggattatagaaaggaaatgttcaggttaagataaaagattgtggagaccaaggttcttttgaagtctaatagtggctgcccttagagacaatagatgacaaatgtttcctattcagatctttaaaaggtgctagacttttagttaatctctttaggattgggaaggcctggaagaataagatctagctatgttaatagagattctttacagatgcaaatttttccccacaaagaacagctttgcaaggccatttcaagatatggcaaagaagcatgttttggagtaaaatattttaattttcttccttgtcttgtaatgttatgccagagtcagattggaaagtaagtcacgatatatataaggttaaataaaacccatccgatgacaatttatgatttgtagggcatgacttcccagaccccttagataggaatttggacaagatgaaaaaatcagaatttagtcctcatcatgtatctttctcaaaaataatagattgatgggaacagatatttggggaccaaagaagccaaagtggttcccatccctttctctctgtaacttaacctctgtgacttggcaagccttcatgttctaggctataaagcggtaagggcaagagagaaaaaaataatagttgagtaccttttataggacatctctgttgtagatagcttttaaatattaaggttaagaacattgctctcactcttcctctgacccccccccaccaactcttttactttccagtttccaccattttgtgtagcccctcctagatttctcagttaatcatggagaatagaacaaggaagccactttcactctgcatttcatgaaaaagatatttctgcagcctgattctcatttacaaagtagcacctacaactatacattttttattccattaagcatttattttcaaaatttaaaccagtactgagaggcattaaacatgtaaattatttctctccatttaagaaatgatttggcaatgcatctaaagaaccatgaaaacatttataccacttgacataataatcaaagttctaaggaaagaaaaggctagaatgcaaaggtgttcattatagatctatggaaaaatcaaaagcagcctaacagttaaacaatcaaagatgatacatgctttatctcatttccacaaataccctttatcccatctgcaaattagactcacaggagcaaactcactctgtctcatctatcagtgtccagtactatataaaaacacaattcctttataaggcttttaactccagatatttatcagaggtcacatccaagtcatgaagggtcaagctctgccaatctccatgaagctctatactcttgagtgttagccagggaacagttgactagccactgcaggttagaagtttttctgaggtattcaaagcccaaatcactcacagaaaaagaatctgatttcagcctctccttcctctttcatatatatccccacactaagaagtactaagtagagtggagtttgagaaactgaacactccttactctagcccttgaggagtttataactataaaatttgtggcaaacataagctcagtctgagtccacaatatgacattcgtaaaattctaactttgtgattcttcttcaataaactcatttgtcatttttaatatcgtatttctctggctttggtcagaactttagcagagtgcagaagtacaatataattttctaaatatattttaagatattgaataaaagccaggcatggtggcccacacctgtaaacccagcattttgggaggccaaggcaggtggatcacttcaggtcaggagttcaagaccagcctggccaacatgatgaaaccccatttctaccaaaaatacaaaaattagccaggtgtggtggtgggtgcctgtaatcccagctactcaggaggctgaggcttaagaatcgcttgaacctgtgaagcagaggttgcagtgagccaagatcgtgccactgcactccagcctgggtgacacagtgagattctgtctcaaaaaaaaaaaaagatattgaataaaaagttattcaaccttgttattaaagtcacatattacaatcttatagcctgaccatccccctgggtgttgctaaacatgaaggctcctcccttcaggacttcacaaacacaatcttattgaaataactgaaagcttctgcttttgatatgagcagcagaggatcctggagattgatggttgtaagaggttatgtaagtttcacacagcattgggttaggtgtcagacttggatttgaaactatattttgtcacttattatctggatggtcttaggcacattgacttttttcattttttaattgtttttatatttgctggtttattataaaggatactacaaaggatatagatgaagagatgtgtaggatgaggtatagggaaagaggtatagagcttccatgccctccctgggtgtgccactctccaggaacctccatatgttcagctatccagaagctctttgaaccatgtcctcttgggtttttacataggcttcattacagaggcatggttgattaaaccattggccattggtaatcaacttgaccttcagcctctcttccctctccagagtttgggggatggggttgaaagcccaaccctctaatcatgcctttgtctttctggtgaccagccctaccctgaaggtgtcagtcaacattaccatataaaaagacagcactttggcgattccaagggttttaggagttatatgccaggaaactgggatgaagaccaaatatatattttaaaatatcacagtccacccctggtatttgaacctggatcctttacatcaaaagggcatgcaactcaaaagatattgaatcccattcagtcattaataattggtccaatccatcatcttgcattaatgtgtcccagggtgaggccactcaggtttacaggcttccttttaatcttgtcaggttccaaaagcagttgttgtctcagcaaacatataacttcacactttcaggcatctggaataactgggctaagaggcagtgtcatctcttgctgtctcttttgaagtatttatgtaatgtttaatttctctcaatttttaacccatttatttactcaaactcacttttggaagggatgttagaaacaccactgtgctggattgcaggcagcaatactagtctagcaagtgcctcctcctcagtctactcccattccaataaggtaaggttacataggtacagaactagtgggctatttttaccaccaggcaatatagctatatacattcactattagcctccattttgccaaatgtggaagcacaatccacccctagaagccttttaggaattctaacatagaggtttaaaggtaaagttttttgcttaaaaagcattcctgctattagtaggagttataattggagccctggtcctaggaccaccacatcaggtaagggagagaaaaaaatttgaggcaatttggagaagaacaaaaattatagtagttataccagtatactcctcctttggtaagaattgcagttttaccagcatcctccccagatcaaccagaaagacagattaaaaaaaaaatctaggccaggcgcgttggctcacgcctgtaatcccagcactttgggaggccgaggcgggtggatcacgaggtcaggagattgagaccatcctggctaacacggtgaaacctcgtctctactaaaaatacaaaaaaaaaaaaattagccaggcgtggtggcgggcacctgtagtcccagctactcgggaggctgaggcaggagaatggcatgaacccgggaggtggagcttgcagtgagctgagatagcaccactgcactccagcctcagtgacagagcgagactccctctcaaaaaaaaaaaaaaatctagtcctacttatgtactgtgagcacacacttgtgaaggatataagcaagcccttcatatctatttctcccccaatttagaaaaccaatatttcaattgctccttccttttggttccatatgaaattttaaagtagttttttctaattctgtgaagaaagtcaatggtagctttataagaatagcattgaatctataaattattttgggcactatagccattttcacgatattgattcttcctattcatgagcatggaatgtttttccatttgtttgtgtcctctcttattttcttcagtagtggtttgtagttctccttgaagaggtccttcacgtcccttgtgagttgtattctaggtattttattctctttgtagcagttgtgaatgggagttcactcatgatttggctctctgtttgtctattattgctgtataggaatgcttgtgatttttgcacattgattttgtatcctgagacttgcagcttaagaagattttgggctgagacgatggggttttctaaatacacaatcatgtcatctgcaagcagagacaatttgacttcctctcttcctgtttgcataccctttatttctttctcttgcctgattgccctggccagaacttccaatattatggtaaataggagtggtgagagaggtcttccttgtcttgtgccagttatcaaagggaatgcttccagcttttgcacacacagtatgatattggctgtgagtctgtcataaatagctcttatttatttaaggtatgttccatcaatacctagtttattgagtgtttttagcatgaagggtgttgaattttatcgaaggccttttctgtatctgttgagataatcatgtggtttttgtcatttgttctgtttatgtgatggattacgtttattgatttgtgtatgttgaaccagtcttgcatcccacggatgacaccaacttgatcgtggtggataatctttttggtgagctgctggatttggtttcccattattttattgaggatttttgcattaatgttcatcagggatattggcctgaaattttttttacattgtgtttctgccaggttttggtatcacagtgatgctggtctcataaaatgagttagggaggagtccctctttttctgttgtttggaatgatttcagaaggaatggtaccagctcctctttgtacctctggtagaatttggctgcgaatccatctggtcctgggctatttttggttggtaggctattaattactgcctcaattttagaacttgttatttgtttattcagggatttgatgtcttcttgcttcagtcttgagagggtgcatgtgtccaggaatttatctatttcttctagattttctaatttatttgcatagaggtgtttatagtattctctgatggtagttggtatttctgtgggatcagtggtgatatcccctttattattttttattgtgcctatttgattcttctctcttttcttatttgtcttactagtggtctatgtattttgttaaaatttccaaaaaactagctcctgaattcattaattttttgaaaggttttttatgtccctatctccttcagttctactctgatcttagttatttcttgccttctgctagcttttgaatttgtttgctcttgcttctctagttcttttaattgtgatgttagagtattgattttaaatctttcctgctttctgatgtgagcatttcatgctataaattttcctcttaacactgctttagctgtgtcccagagattcaggtacattgtctcttttttctcattttcaaagaacttatttatttcttccttaacttcattatttacctagtagtcattcaagagaaggttgttcagtttccatgtagttgtgtggatttgaacgagtttctgaatcctgagttctaatttgattgcactgtggtctgagagactgttatgatatctgttcttttgcgtttgctgaggagtgttttacttccaactatgtggtcaactttagaataagtgccatgtggtgctgagaagaacatatattctgttgatttttgttggagagttctgtagaggtctattagttctgcttggtccaaagctgagttcaagtcctgaatatccttgttaattttctgtctcattgatctgtttaatattgacagtggggtgttaaaatctcccactattatcatgtgggagtctaagtctctttgtgggtctgtaagaacttgttttatgaatctgggtgctcctgtattgggtgcatatatatttgggataattagctcttctcgttgaattgatccctttaccattatgtatgtccttctttgtctcttttgatatttgttgatttaaattctgttttatcagaggctaggattgcaacccatggttttctttttttgtttgttttttgttttgttttgttttctattttcttggtaaatattcctccatccctttattttgagcctatgtgtgtctttgcacatgagatgggtctcctgaatacagcacactgatggcttttgactctttatccaatttgttagtctatgtcttttaattggggcacttagcctgtttacatttaaggttaatattgttatatgtgaatttgatcctgtcatcatgatgccagctagttattttgcacattagttgatgcagtttcttcatagtgttgttggtctttatattttggtatgtttttacagtgactggtacccatttttcctttccatatttagtgcttttttcaggagctcttgtaaggcaggcctggtggtgacaaaatccctcagcatttgcttgtctgtagagaattttatttctccttcgcttatgaagcttagttttagctggatatgaaattctgggttgaaaattatttgctttaagaatgttggatattggcccccgctctcttctggcttgtagggtatgtacagaaagatccactgttagtctgatggacttccttttgtaagtaacctgacctttctctctggctgcccttaacatttttttcttcatttcaaccttggtgaatctgatgattatgtgtcgtaaggttgctcttctcgaggagtatcagccagtctggtagaatgaataaaagccactataaggtctgtttaccctgagaaggggactgcccaactctccctataaaatgccaagtggcgcaccctacatgaagcagctgatatgcttcatatgcaagtcatgttggactggctttaccatgatattcgcccactgaatatgcccattacccagaccatggtaaatgctacggttcaaagggacccttctacatgggtatcctgggtgccattactcctacagaatcaaacaatggttcaagaagccttatcaaatatgctgttgcagcttttcctcatgagtcttacaggtgctaataaaacataaggataattaaccaaaaaaaatgagaaaggcaaaaggggagtcaaaggactcatcttagaagggtagaaatctttagatggttattaagaaatgaaatagccaggcacagggctcattcctataatcccagcactttgggtgaccgaggcaggcagatcacttgaggtcaggagttcaagaccagcctggccaacatggtcaaaccccatctttatgaaaaatacaaaaattagccgaatgtggtggcatgtgcctgtaagagtatgaattcccctggagtctgtggtttccaagggctctatgcactcatgctagcccacacttggcctttagatgtttaacttttaatcgaattcctcatacttgcttatatggaggccttatcttcccattgacacaggtgagccagtgttcatgttctgtcttttcttgaaaaagtccatctttccttagagttcaggctagttagttgccctgcaccctcagctcttcaataaattcaaggtttgttttgatttttttgagacagagtctcactctgtcacctaggctggagtgcaatggcatgatcttggctcaccacaactgcagcctcccaggttcaagcaattctcctacctcagcctcctgagtaactgggactacaggcacatgccaccacacccaactaatttttgtatttttagtagagataggatttcaccatgctggccaggctggtcttgaactcctagacctcaggtgatctgcccaccttggccacccaaagtgctaggattacaggtgtgagccaccatgcctggcctcaagttatgattttttagtttatcggtatttttcttattgttatgtggaggacactgcgtttgccaggttttttgtttttgtttttgtttttgttttttgagatggagtattgctctgtcgcccaggctggaggacagtgatgcgatcttggctcgctgcaatctctgcctcccaggttcaaatgattctcctgcctcagcctcccaagtagctgggattacagttgcatgacaccacacctggctaatttttgtatttttagtagagtcagagtttcaccgtgttggtcaggctgatctcaaactcctgacctcaggtgatccacccaccttggcctcccaaaatgctgggattacaggcatgagccaccacgcccggctgcctttgccagttttctacatcctatgtggaacccagaaatccctgatgtccatttgtgttgtagttatctagttttttttctagttgttacagtgggaataatggtctttcactatcttctacattctgacccaaagccaaatgtcataataacctttctgaaacataaattggatcataacactcctttgctttctatccttcagtggtttctaatcatacatcaaactttaaaaataataaaattcaaaatttttcttttgcttgtaatatcctgcatgatcttgggtctttttgctgtcttttttttctatcttttcaaacacatctcatgccattctccttattttctatactccagccaaggagttggcaatcttttcttataaagggcctgatactcattattttaggcttttgggccacatggtctctgttgcaactacaactcttctgttgaagcacgaagcagctatagacaatatataaatgcattagctttgctgtattccaataaaactttattaatggacattgaaatttgaatttaatatattttttgtttgtcatgaaatattctataatttttttcttccaaccatttaaaaatgtaaaagatcagctgggtgtggtggctcacacctgtaatcccagcactttgggaggctgaggtgggtggatcacgagatcaggaattcaagaccagcgtggccaacatggtgaaaccctgtctctactaaaaatacaaaaattagctgagcatgatggtgcacactgtaatcccagctactcagcaggctgtggcaggagaatcacttgaacccaggaggtagaggttgcagtgagccgagatcgcgccagtgcactccatcctgggcaacagaacaagactccaactcgaaaaaaaaatcaataaaaatgtaaaagatcattcttagcttggaggctataaaaaaggatgcagcatgtcagatttggcccattagctgcagtttcctgacctctatctacctcaattggttctttacttacattacatggaaagtgcaaacttggatggcttcaatgtctggcttcttttatttatttatttatttatttatttatttatttatttattttttgagacggggtctcgctgtggcccgggctggagtgcagtggcacgatctctgctcactgcaagctccacctcctgggttcacaccattctcctgcctcagcctcccgaatagctggaactacaggtgcacgccaccacgcttggctaattttttatatttttagtagagacggggtttcactgtgttagttagccaggatggtctcgatctcctgacctcatgatccgcccatctcggcctcccaaagtgctgggattacaggtgtgagccaccgtgcccggctggctggcttctttttacccttcacatctggctttaaatactaccttttcacagatttcttctctaatcactctttctaaagtaaatatgctgtttttcattattagtcattgcatcctatttctttccctttaattttcttatcacaatgtataattatatgtttttttttttttttggttattgcctgtctccctcaatagatcataagttccatttgataaggtacaatgtctgttggtttattagccagtgcctaacactaccatttaatatgtattcaatgaatatttgttaaatgtattgattgaatttaaagtgactactcagcctacttctgccccttggagcttggattgtttcttcaaaggtattgatccttttgactattttaattatgaattcactaaagacatctggaaggcttattgtgtcaagcagtgccaaatccatggcttgatgaacctagatccatccccttcccctttccatatcacagatgacaacttgatggttggcctatgacttgtaaaagttgtcatatttgaattctgaaatttctctaattttcttgggaagcagaaaggaaaaattagtagttggcctcaaagggacagttgaatttcacatataatgagcaaagtagtgtgaggaagagaggagggccttttcttttgaggtcataactaaaagttaggtgagcaaatgccataagcatgaaaatagcaaaccaagcttcttggtttctatccaaaggctttgttgggaaaagtatcaaagtgtgttcatttgttatgtaatatataaggtagagaacccaatttgaaggaggtggaataactttccaaaatacttatggctaaattctcagttgatcttggaataagattcaagaatccaaatgcacccttctttgttatcttgctagaaaacatgctgggcatggtggctcatgcctgtaatcccaacacgttgagaggccgaggtgggcagatcacgagatcaggagttggagaccagcctgatcaacatggtgaagccccgtctctactaaaaatacaaaaattagccagacatagtggcacgcacctataatccgtgctactcaggaggtaggcaggagaattgctggaacccgggaggtggagtttgcagtgagccaagatcacaccactgcaatccagcctgggtgacagagcgagactctgtctcaaaaaaaaaagaaaagaaaaaagaaaagaaagaaaaaagggaagggaaggaaaggggggaggggagggaagggaagggaagggaaggtaagggaagggaagggaagggaagggaaaagggaaaacaatgtgcttttacccacagctgataagcttttctaattgtctacctttgggttaaactttatcattgagtgtttttatcccattatgaaagaattaaggtttgaaggactgaggtaagggtggatatttactcttaattgagtagcttaaccaagtcaagccacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgagtgttttggtgtaactgggtttctttatgtacaaagctacagaattccccttgaagacactggccttgacatccctgaaatagcaaaatagacttttttgtttactccacgtgtagtatatgacagttagtgcattgtagatagggccatctattgaaatctacatgtgattatactctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgacacacaatttacccatggaaatttacccattggcttttgctgcaaaagtaccccttgaacctaaaataaaagttggaagaaaaaaacttaacatagcaaattcttagacattgttctgacttgtttgcaagacctatgctttcttcctaagctggtgctggatagttcttttgacttttttcattattgatcttctctctccctagcattgccaccaagggaaactatttcatgtaagacattcttttccatccagccatctggttggccctaatttctctgagcacatctttcccacctgtattgtgaaccatagagcaggcctaagggaaggttataaagaaggtaaggttggtctgtattgtctcagtctcttttaatatctattcccttctgtatggtactccttcttctcagagactcctgttctctagcttcttcataatcggctttcaaaataggatctgctgtcagcgatttatccctttagtgctaggatggtaaataaattttatcttgcatgccaactctaaattattagtagcagccacctgaaatgctacgtgaaggattctggggatgcatccagttgaattagttatgagaagaaaaattggctactataggaaagagaatcaacaattcaatggattaaacaaaaagagtgttaattatttcttacatgacagtatcaatgtaaaaagttcaaatcagagagggaattctgtttcttagtcattcagggacttgatttccttccaagtcattgtactttcatctcatagggaatcactcccatctgtatactgaaactgggtagccattacatctgagttgcagctggtgggagaaagtatggaaaggagagcataccctatgtcttaggacccaggcatggaaatggcatacatcacttctactcacattttattgatcataacaatcatttggctgcacagaactgcaaaagaagctgaaaaatgtaccctagctgggcagccacacatcaagcaagaatgggagaatgtattttggtgggcaacgagcatttttgtcccttactaggcttaacaggaatcaatgctatgattaattaatgaaattttccacgagttggaaaaaaactgtggcatccacccatattatggtattagctgatcttgccttaagtgtgaaatggaagtcttgttttctttcctagagggtcctgaagtttaaatataattccaaaaaatttgacaggcattttccactatgagaaaggtacttttgttaggtacaaaaataaacttgtccctgctttatcacttaatgtagaatcaaagattcgtctccagataacagaatttcagacatcagctaccaaggagggaaaatataggcttgggaaagaaggccttcttgtatgaaatcacaccacacaggcactagacagctctacttatataaagtttagctctataaaaatgagattggggtgtttcagagattttattaggaaatgtacagagaaaacagttgatggggcaaaagctataaacactaaggtgagaaggaatcagaatataggcaagagttatagaagcatctaaatggcatttgtatctgtttaatcagcctatcaggtaaatctgcccacttttctccctaccagtgaacatctgttttgaacctctaggatatgggacctcttgcttgataccagtctttctgtgcctacctattctaaagcctgatgtcatcttctgtgccttcccttataggcttacttccttcaacgctgaccattcctccagcatttcttattctaaagaggaacaggtaagaaacttcgttggagggaaaattaagcaaggattggcattagagagggagctgtgcacagtccctgtctcaacaaaaatagcttaagatgagacaagtactttacttagcataatcttgctactgaaggggctattctaaatgtccccccgcccaacaccattatgtaaacattctctaatattcgctacttaatttagattatccacccttccttctggccattgcattccttatctagcaatgcaggaaaagggcaagaaatcaaagggaaggaataaagggacttctgtttccagactgtattttaaagggaagtcatggttggttagcgattttctttagcttttgctttgcgtttgcagaatagctaatattattgttttacctatgggaactggtatccaatctagtgcccaatggggctgttgttactagagctattttctgtgaacctcatagcagactctcttctgctgaaaatgagatttactattcattctgggttctctcaaaagccagcctgccatctacaattagcggtcacatccatttggctatagttcaggtaagtccaattcttcatgtcctgcttctcagctctctgctgctcagagccaaaaaccttatcttagaaccccaaaatacatgtctagttgctgtatcaaagaccaggtagcagcctttacagaaagtcccttttctcagaatctagttgagccaatactatgcagtgtccactatattcttcttggttcattctctttcttttggaggcaacagcttactatggtgaggacaactggaatccatctctacctattcaccactttttaagtagtaaaattggtagctcaaaagtaactttattccctgctaagtcttgctctttccaattattattcaaacatgagaggtgacagtgagaagattggtttggcattataggatggtaccatgcaaggtactctaacaaccggccttctgtctcatggtctatctccctgcagattcaggttgcatcagctgtcctcctatgtccacaatccaaatgctatgggatactatggcagacaagttttccagttcttcaggaagtagcaactgtgagtattctagctcacaatgggaggagcacaacgactggactccagccatgagcaaatacaagtaaaggtttaactgagactgtctgctccccagttctccaacccctgcctaccccaagcccctttttgtcttgatttatagtagaaaagtaatagtcggtcgggcgcgggggctcacacctgtaatcccaccactttggaaggacgaggcaggtggatcacccgaggtcaggaattctagaccagcctggccaacatggtgaaaccccatctctactaaaaatacaagaaaaaaattagctgggtgtggtggcaggctcctgtattcccagctactcagggggccaaggcaggagaatcatttgaacccaggaggcagaggttgcagtgagctgagattgcgccatcacactccagcctgggcaacaagggcgagacgtcatttcaaaaaaaaagaaaaagaaaagtaatagtcacaaaatggatataaaaagagaggtaacaatgggaaactacaggggggcaaattaatacttttatagtttcagcagacctgtagtaacagaagaaaaactgattttcacttggttcagactatctccctgggctagaaagtatagggccaaggtagaggaatcggaggtagatgaattatcttcctgtgtcttcctttaagtagttcacattgctcccatttaggtaccagttaatagtcataattactataatccctctctttggatattctctaagactttatttcctcgtgagcataaagacataaaatagtacactggaggttagctatgattaggaagagccattctaactgtaaattactcataatccaagctctttcctgatgagcatgtatccgttataaaagaggctatgataatatacagtgagaaaagaatttgtttagaaattaagtgaatttggatctagggtcacctcagctattttgcgctgcgacattgatcaagttattttctctgggtttcagatgcctcatctttattttgtgcatttagatacacaattctaattggcccaatgggaattacacagctaacaccatcatgcagcaaaacaaaataaaatacagtggaactgaagtgagggagtaaaaccaccacactatgcagatgagactatctgcctagtaacaagacatttcttggactctggtacttcagccaaatgtcctctgggagtggagaggcggggagacaatatagtccactgccagaaagaacccacatctgttccaccactctcattgtcattgcgtttcctgggatactttcagaataattcattagtaacaacaacaacaacaacaaaaaaaaaaaacagcaaggaaaaggctacaaggggaagggtttttctaggtctttgggatatatctaatcatttcttcacggaatattataaagtagggtccactcaaagctcatccctcacaagccactcaacctttgacattcttcttctatttaatgtgagtcagaattcctaagattttttgaaatcctgcctgcaaagtctgcttatgaatttttttccttaccacggagttcccataaagtgacaggttctgcctaagtagttagctacctgcaaggctgctcgaatccaactttctttcccactctactttgcattctgctctccctttgctctcctctccttaggccctcaagtgatgccagcttttgttctagcactctagaaaggagttactattttgatccagagtacacagagaagagaaactggagtgggtaaaaggaagctcgtcactgagaatgctggtactgggagcaagactgtggcaaacccaggaaatactaacaataagaacccctcaaaagttcacctttaccaagccaatggaaacaatatagctgagtggggtttgaattttgagaactaatgactcctcagctaccatgtaattgccttggtgctccatttgctataattcatgggaaaggtactaaggtccttcaactggttttccttgctacctccacctttttcagaagttggacctatgattagcacacttcctgcctatccattcacagtgaatagaatggctggctaaattttaaaccccatttaaattattccacttcgaaatttgaatgatagatgcttgcctaagtctactggcctcagtaacattaccttttctcatgaccaagggtaaaagagtaaattgataggaggcacaagtttttgtggatgtgggttgggctggcaccaaatccaactacaagcatacagtgaccacttcatacacaccacataaaaaatacaaaaactgaaaaatactatcaaatgctttgacattttctaaatatttctgctgcccctataaaattgccttgtctgacctttcctcactaaccaggagatacggtgtttttcatttcctctcccttcaaattttacaagagaatcaaggaatttgaggaccaaagcaccacaaacacaagagtaagcacagcaaatatgacaaggggactgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacataggtaagagttcttcaggcatcggttttaaaggtccatgtactgggacgggtgcggcggctcacacctgtaatcctagcaccttgggaggccaaggctggtggatcacctgaggtcaggagttcaagactagcctggccaacatggtgaaacccagtctctactaaaatacaaaagttagccgggcatgatggcgggtgcctgtaatgccagctgttctggaggctgggacgggagaatcacttgaacctgggagacagtggctgcagtgagccgagatcacaccactgcactccagcctgggtggctgagcaagacactgtctaaaaaaaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatgtttccacagaactttgaaacctataaagtcaaaacttttaggtctttagagagaaaatttcctcattcaacagaataggaaactggcataaatgggaaaatgtcttgccaaatatcacttgatgagtcactagagacaccactaccagtcatagccttataccttagttaaagaccagaactgccgggcgcggtggctcacgcccataatcccagcactttgggaggttgaggtgggcggatcacctgaggtcaggagtttgagaccagcctgaccaacatggagaaacaccgtctctattaaaaatacaaaattagccgggcgtggtggtgcatgactgtaatcccagctacttgggaggctgaggcaggagaatcgcttgaacccgggaggcagaggttgcagtgagctgagattgcaccattgcactccagcctgggcaacaagagcaaaactccatctcaaaaaaaaaaaaaaaaaaaaagacttccatcctgttttaagtgccaatcagctaggaaagagtccctttaaatgattaataactgagatcacaaaaataatagatatgagagggaaaaacataaggtcttcccaatgtttaaggctcacttcgatgttttaagacccctcaagtttgctttaagtctcctggctcaggactaacaaaacacagccttagagcagcattttcaaaactcacaatattgctctttgagataaaggtgagtcactctggaaggcaaatattctcacaataagaaaattcacataggttgtttaacattgcagctaaaatacaaaaaaaaagaagaagaagaagaagaaaaagaaaattcacatagactactggccctaggagaatttatctaaagattatgagtacaatagatagatcttcctagataactctcaacttagctttctagttcctagactttctaacaatttgttagtaactctctatttctaaatctacagagatttctagtcaattataacatttcaagagttcttacccatgaaaatatttcatgaaatttatagctacccactatttacgaagaatgctgggcaaagcctatacgttcaggatttattgcaccgaatggtcacctttatctgccaattctcactcgctaatcagcctctcccaacactgacctagagaatgtagggtcctggttctttagctcctgcctgatgacagataactttgtgccatttttagtcaggtttccatttgtatttatgcggcttccatcaatcagcaaccatagcataaaaagacacacctctcacttgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataacaacagctggccaggcgtggtggctcacgcctgtaatcccagcagtttgggaggtcgaggcgggtgaatcacctgaggtcaggagtttgagaccagcctgaccaacatggagaaaccccgtctctactaaaaatacaaaattagcctggcgtggtcgcgcatgcctgtaatctcagctactcgagaggctgaggcaggagaataacttgaacccaggagacagaggttgcagtgagctgagattgcgccattgcactccagcctgggcaacaagagcgaaactgcgaaaaaaaaaaaatacacgccacaaaaacagttaagcaaatctatgcagaaggaaaaacaaggtacagaaaaccagggattcagtaaattccttatacaggcccccggggctctcctattccactttttaacaatttcaattgtttttcaagctaagaaattttgatttcttaaaacaaggaaatggcagtgataatggaattaggcctaccaaaactgagctaatacagatgaagttagtcttatttgtaaacaaatcctgagaacttaatacccatctgccaaaggaaagtgggaataatttaaaaggccactaatcaaaaggtgttaagttcattaaatctatcttgctgtgtggtgagaaaagaaataatttagtgctttgcatctctcattcttcattggggatcaagtatgcttgcccttacagacctcactggagcccagctctgagggataaatgaaacaggccgaactcattatgtaaagttaaaatgtatgtgtacatgcaaaagaaaaagtataggaattgatgaaaactggctcacgttctgcttttctttctttttaagagactgggtcccgctctgccacctaggctggagtgcagtggctaatgatggctcactgcagccttgaactcctgggctcaagcaatcctgctgcctcagcctccagagtaggtaggactacaggcacgtaccaccatgcccaactaattttattttattgtagagacatgggtcttcaactcctggcctcaagtgatccccccacctcaacctcccaaagccctggaattacaagcaggagccaccatgcccagctgtgttctgctttaaaaaggagagttgtgggaagttcaatccaaagacagaagcactacaacaataaattccccaaactacctttttctccagatagctggcaacccatccaagtagattagctggagcttggccagattctcaaagggaaagatatgattaatttggagcctcttatagctgtttgcagtcctcaggtctcacatgctcagaatgtccttaagaagaaagacagggttcagtaggctaccaaagcaccggtaggataccaaaagagttacaaaaaccccaatgaaaaaaacctaggaagtataaactgaagcattagacataggtatctcctgtctctactttctagcctgcttggtctccctaaagtcctctaatgacaagccctggcagtacacgggaagattagacaagtgaagaaaaagaactacatgaaaatatgggtcaaaccaataccgaccttaagggctgacactaaatttgtggctaatggtcatcctgttgctgaaaatacttcaagattcaaggtggtgtggcaactgctactactgcttagaggtgcaattgtcttgactgtttttaataattggctatctacctttactatagcataggagctcactaaaggggatctaagccaaatttgcagtcttgaaagcactttgcatggtactgtatagtatggtgtgaaaagcacccagtatgttaaacctgagtaccttaaatgaatacaggcttccagatccctgatcagggattactgtatcatgaggaaacctttatgtcaatgtcaaacaggaatatatggaacatcacttattcaacactattctctagctttaaaaaggccaaactgttctatgatgttctcaatataagcagaacaagcttcaaaatctcttgccaacatccttccccatcctaatttaatctaagattagatacttgacttccaaatgcaggcttccagttaaacatggcggttcatacatgtttatgcatttactctactgcttcctaaaactccattaatgagagtaaatgtgcactccatatgcaagcaaatacacctaaagaaattttaaataaacggatcctagctcaaattcatttatacactggcatctaaaagggaacaactattccagtctccccaagtcttcttaagcatatttatggagtatcttgctttagcatcaaagccctctagttttgcctgttactatggtgatgacatactcaaagagcattccctttcccttaacgggaatctaaggctagagaaaatggttacattttggaactgggaatctaaggctagagaaagtggttacattttggaactgatacagaaccatacatttcactagggttcaatattcactgacaagaattttgagaatccgtcatcttgcagaccaacaaaatatcaaagtcttatggagagaataactgagtggcacagccagccatctggttcaaatactccagcatcagacagaattgtcacagctagacgtgatattaataatcacataggccaggcgcagtggctcatgcctgtaatcctagcactttgggaggccaaggcgagtggatcacctgaggtcagaagttcgagaccagcctggccaacacggcaaaactccatctgtactaaaaatacaaacattagctgggggcggggggtggggggcgggtgcctgtaatcccagctacttgggaggctgaggcaggagaattgcttgatcatgggggaaggaggttgcagtgagtcgagatcgtgctacttcactccagcctgggcgaaagagcaaaactccgtctcaaaaaaaaaaaaaaatcacataattcaacattttcattctctaaggaaactgggaacccagaagatgaaactacctcaatgttacacaaatagaaggtaaccaagtgatacttaaacccatgtcttcccacaattcaaaggtcttttaactgtggggtctgtgcatagattctcaggacatatggggagctttctacaaaactttcacaatactctcatttcactgtaaggatagtttagatcagctatatgactacttcataatataggaccacgttgccagattagtggcaaatgttctagttttgttgcctggggattacagaaaagaagagaagcaaacaatatataaatgtgttttgtgccaaatgaaagtgaaatagcattgctatgtgctataatggcaggatttaaagcagtttgaaaacagcagtttggtgaagtgcatcaacacagcatgtgatattacagacacgccactcaaaagaaactataatactataatagtagtgccatatttgcattttagttatctattaactactaatttgtacatctgctatgttttatagttgtattatagatgtaggcaaacagatttcattccaggtttgttcatacactttaacttaacaattattcccataaacctaaatagtacataataatatttttcttttacagaaaacgtttaatcaaatatagcaaaatattaattgtagaatctaagcagtgattatgtaggtgcacactgaataattcttttcttgagagaaaacctccctactatcaaacttattatacagacttgagaaacactgtctcaaactaatatctaatataaaatattaaaattatactcaacataatttcatgttattttaaattgctgattaatatgcaatgcacatgacaatgctgttaatcagggcactttttgtaacagcacaccaactttcttgactaaaattgaaaggttaaaaattatatttgggttacaattgccaaggaagacatctactccttgggtcttaaataggcactttggaaggctagctggaggtcagtaaatgaacctttcctatcccacgtgtgaacatgcctttcccttcctttcccacctccagtgttctcagggtcctttagctcttagaaaaaaacggaaagaagaaatgcatacccaaggaacagcttacctggcgatatcagaataatttaatctgaaaatcaatgtcaaaatgtggattgaagtaaattctggttcttaagataaagtttgtttctgcaacctattttacgtttcaaaactggcagaaacatttagggcagaagggtcatttctagtttcaagaataccctacagctaaactctccctaaacttaaccatagaagcaaatgtcaaacactcactaccgtaatattaacagaaaaatttcccaaccaagccaggtttctcactgtagaaatgggaggtaacagataagcaaggaggtgagactataatgatccatgtggcaatgattagagttggagacgtaggtataaacacatttagtttaatatagatacagatggttatatatatttatagctatgtgcatatacacacgttagaatgcaaatatatatctccttgctcttgtcaactgaaaaggtcttgaaggaatgacactccagtagtaatgagcgcacctagcattcacttcttgatttctaatattactctccaataaaaagtatcaaggctccttgcagaaatacatcattttaggtccaggcaggagatatgcaaatgagtctgaagcatgttgtagttccaaaaataagaaagtgctcaaacaaaaaacccacattcatggggttatatcaaagccaaatgaaagacctcccaatggccaaagctggaacaatttgaacaacagaataaagtaatactgtattataacccagagtataaaatatccctgagatcatactgatataaatgactgaataaacacaatacattgtggagaaaagacatcctgtgcaaaagaattccaaataatttatgtaaatactctgccctcaatgaggtggaaggtaatttcccattccttaagtgctggctgcacatagtgacttcctatgtgaacagtatagtagggaaatggagaaataaagactaattttacgctggagaaacctgacaaatagtacctcagacaggtgattaaggataacataaacagtgataagtcatgttgatagtatgtactcttgataagtgataagaatggcactctacctttgtggtcttcctcctaaacactcataaacccaatctagtcatgagaagaacatcagacaaattccaatagagagacattctatagaatactggaccattagtcctcaaaactgtgaagttcatcaaaaacaaagagtctgagaaactgtcattaccaagaggagcctaaggagacatgactactaaggacacatgcagcgtggtatcttcaatgggatcctggaacacaaaaagaacattaaggaaaaactaaggaaatctgaataaaatatggactctagttaataataatgtatcaatattggtttgttgtgacaaatgtaccaaactaatgtaaaatgttaacactgggaaaaactgggtgtgaagtacacagaaactctatcttcagaatcattctgtaaatctctacactgttctaacattaaaaggttattttttctaaaaatctcccaaccagttgctgaagacttataagacacagtttttaaaaagcaagcaaaatggaacctaagaactggtaagtctatgttccagatttttctacagtacgtaccatcattgtttgcagatctgatctaaagacttactctctttcttttctgtttatatggatttataataggtaattttgatgttaaaatatacaaggcccaaataaccaggtatccgtaatatcaaaaagttattttttaaaaaaacattagcaattaaactttgtttttgtacatcaacagatttcctggaaagacctagtcaatctgctgtaaaaaataagtcgtaagttagtagctaattttcagtcaagggagatctataaggctggaaaactttaataacatatagattgtagagtgattatatcccatcactgttcaatgccaatcacactaacagcatactataaaatatactatgccactagttttcaaagctatgggtaaagtaacatagataattttataatgggacctggtaaagtacagtgatgttccagtcatatccctatttttaaattcttatacgcacttgattatgtaataagagggtattgcttgggtctactgcataacctctcatgtttccgggaacactagaagactagcattctaattggttaaggaaaataatactttaagtctacccataatttaagaagtctagcaccggtcaaatttacattttgtttcagtttctcatcctaacatgaaaaaaaataatcaaaagttatttctaatataaacatcaaaacagtaaaggagaggcttctttaccaaactcatttgtataagatgcagaagaagcccaagctccatgtatcagtactcaatttggaaaggtcaaggaagagctatcaagtaaagcctaagtcaccaacaaaaacatgaccaactcgacagcctaatacacatatatatagtgatatataactgtacatggccactgaagtttaacttgttaaattcagcaggccagctatgtcttaaatacatgagctccaacttgagttggatttttgaaggaaacctgtgtaaaatgctacttgcctacagcccaaaatatggtagtgagaatatcaattttctcccaatccagtctttaagacaaggcagaggaaggcattagctctgtttaactgacacatcattactctttgccatccaaactgataaggtttgggggaagagaagaggcattagctcagttcagatataatcattagtttctttctctttaagctggtaacgtatttttccaggatgctttcacatataagaatattttagcagtcaacaaaggtcaactcttaattcattactttaagacatgaactcccttcaagctgtacatttgataatcagggcacaaacaccctgaaaagaaattatgaatgcctaatcacagcagccctgggtctcacagtcttctgtaatttagggaggtggctagagaaatggaagttacagaaagataaagctgaaagaggatatgagaaaatggtcagaaaacttcctccaatcctacatgttaaggttttataaagggaaaagtcagaaaagaaatgacaataatcatttaaagaaatgccaaaaaagtttccttcattagacttttgaaaattttccaaatcacaaaatgtcattttcagggatttaggtatttgatataagcccctatcttatttcactagcagtctcgagatggtcagattgatggtgatctgaaccaaactcagagccaggactaaagtctaagcatttctgcccaaaaccataatgatttccttctgcatcctccataagaaagcaaattccttgatataaatcctgtctttggttttgctatttattccagcacctggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctacataagttatataaaacacatctttgacaaagacaacgtgaaattggaaaacatatttacatttcaaatatctttgttaagtcagtgttcctcaaaacacatttttttaggatctcagaaaattttgttcctttagaaggtgtttcatcatgaagcattacttgggtttgagaaacaatggcacagaccatgtttccaagaaggttcaagaccatgatgtatataaccctcagtcagccagacaatgttgttaagcatatggagtggggctgggaggcatggaaacaagccctgaggaaatatggatatgaattaaaacgggctataagtgaagccagttcacttatatggttcttgttgctcctgctgtgatgcatgaatgtgcaccagaaaaaaagtttcgaatgttatgttaaacaatattttgtcagctggaaaacattaaggaggctaagcttcttttagctttacgaaaggtgggaggaaagaaggtatataaactacagcataaagtaggcaaggaaggtcaaggttttgacttcacttctccactaccctcttggcaaaaaggttccaaacttaaaaagtatctacgatatgcattatccatggtcatctgttcttgggcagaaatgtagtaaaattgtggaaggagccgaagtattagatttatgccctcaatctctgaactttaaaatactcaagcttatgagatttagcaatcactaatttgccaaccttcgcaaatagccaaacacaatggctatgctctatccctttcatctctttccatggctccaaaagaggtaaaaaacaaatgaaattaaaataaaccaactggactatccagatggctgcaatattaatcctatcttggcttaaagagaaaaagcaaacccacttccttaagtttattctatcaacttcaaatccttgtgggttcccttcctaaaactactacttatgattcacacaaaacagcacttattattttctaaagttatttcaaatgtgctcacattagctcctcaacgataaaatcatctcaggaatgaaattatataggatgatatcattcctacccaggttatcagtgtaacctagcatagagctgggtccacaatattaattctacagttctgctggttaactcacatatgtgtatttatgcatgtatgtatgtatctatttctctctctatatatatatattgcagatgaggtgggaagaaggaaagaaacttactggaccctctgacttttctataggtggcatctaagagaaagaaaatagaataggaaaaagattacttaatagctacgaagtagtacttacagtattctaaagagccagagactcttctttacagctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgctttttaaaagcacctctgcatatgttccctcatttaatcgttttactgcaatcttcttgaaataagtaggggcaggtgctccagatgaagaaattaaaggattataaaatttaggtagtttttctaaaagtgaatgctggtaaagcccacacaaagatactggtcttaagagttccactctagaatatctttgatattaaaatagcaagagtcagtgttctatccacagacccaccaccctcagttaaaatgagagacactggtcaccaggtacatagtataaatggatattttggcttcaaaaaaataatgaccaggttatcgagtccaccctacaatccagatgtctttcttaaaaaaatttttttaataataataagcaatttttctggctgtatcctggcatttggcactttacaataacaatatacaaaggggacaacaagagattcttaaccaggcaatctgctctggaaagaagaatgcagagaaagtgccaaccttccttcctggggagacaattttatagtgtacactggaaacacaaaataaaggatggcaatccagctccctgggtctgacttgccttcagtattttgcacagtaaagcagtaacacaggtgggcaagaatggttcttgtccccagaatctgacaataattgaaactaggatcattaataaatgaaagaaaatgagtgaaggcttatccacctagttcaggcctgcttttcatagtcaacactgcaccaacacaccaaagtggtagggagatcttggactgatgggctgaaaaatgggacaatcagtactgtgtttattaataacacagaaggggctttgggtagtcagcatactcagaagcaatgcgaaaggaagtagaggggttcatgtataatgggtgggaccaaggaaagtgcaactgagaattgtttaagtccaagagaaagggccttgtctggtcaacattacccagcaaagaggcaaaaggggcagggcagagggaagggaagagggagacagcacaatcttacctaatagctgcaaatatggacacctgagattgtgagcaatagtctgtaaaaaggggccaagggcacacaaggggcagagagagggaagacttcgtatataaagcatgacaccatggctacctgtgattttacacactggcgcaatgcaaaagggttgggagtatggaccactgtttgatagacaagtgcatggaatactccaatgcttatactttattatgccatgggaaactaagggtggggtggggcgcttgcttaacaaggtcagggagggagaaaaccattgataactgccattgtgcctattaacagtcccaggagaagttttgagtagtcagcagcccctgcagtaatgcaaaggggatactagggcataatatcccactctaccagaaggagacatatataattgcaaatattcacattaacagtacaaggggccttagtgggtcagtacccccgatgtaagcaacgaggaagcaggagtcttatctaatgatcagtgcccttgataattgttattaatgctattaattgtccaagagctgagattatgagtagttaacacttctcagcagcaatccaaagggtaatgggaggaacatagggtctttttctcctacacaggtccacaaatacaattatgacattaatattaaaagaaaagggttcattcataattaacatgcccctgatgcaaggggaatatgtggagatcaactcttagtctaaaagaagaggtggacaattgcattaatgcatattaagtccaaaagaaggggcacttagtgaatatcatccccctgctctaaagcaaaggtggtacaggaacatgcttagagaattgagtttgtgcacatgaacattccaagtgacagtcttgagtagtgggcactacctgctaaaaacactaagaaagtaggtaggatccttatctagtgcacagatcaggagcaaatgtaattgcacatattaacagtccaaaacaacaggactttggttgatcaggacaccctgttgtactacaaaggaaaggtgatggggtatgaccttaatctactgacaaagacaaaagaaaatttcaattatatgttgatagtccaccagaaggggccttggagggaaacagtataccccacagtaatgcaaaagaggtataatggtcctagaagtgatagggttgtggacaactgcaattattcacattaactgttcaaatgtaaagatcataaggagtgggcacccactattgaaaagaggtggggcatccttgtctagggcacaagaaccaacataaatgcaattatgcatgtcaacaagccaagaaaaggggacttagggggtcagcaaccctggtatactgcaaatggagggtgagaaggtagaactttgtttaattaggatgaaccatgtggtgattacatacattaatgtccaagggacattgttgtggtcaattaaaaccatgtactttggacaaatataagaatcttaaaaagtagtgggtactccttgttgaaaagcaaagggagtccatgagaaggtgcccttatctagtacacaagaatatagacaagccaagcaaagaggcctcagtgatcagcaccccagctatactgcaaagggggtctgagagtaggactttattcaaataggataagccatgtgcagttatgcacataaatttccaagatgcatggttgtggtcacttacaattgtgcaccttgattgtccaaatgtaagggtcttatggagtgagcactccctgctgggaggaaaagaaagattatgcgtagatgggatggggcagaggaggcttccttgtctagtacacagaaacctggacaaatataatcacacacataacaggccaggaaaatgggccttggttatcagcacccctgctgtactgcaaaaggggtctgagagtaaggccttattcagatgagataggccgtgtgcagttacacacattattgaccaaggtgcatggctgcggtcacttagaattgtgcaccttgactgtccaaatgtaaggttcttatggagctggcactccctgccagaagggaaaggaagattgagggtggggtggggcaggggaggcttccatgtcttatacactggaacccagacaaatataatcacatacgttaacaggccaggaagaggggccttggttatcagcacacctactgtactgcaaaaggggtctgagagtaggaccttattcagatgggatgggccatgtgcagttacacacatttatgtccaaggtgcatggttgtggtcacatacaattgtgcaccttgactgtccaaatgtaagggtcttatggagcgggtacttcctgccagaagggaaaggaagattgggggtggagtgtggcaggggaggcttccatgtctattacacaggaactggaacaaatataatcacacacataacaggccaggaaaaggggccttggtgatcagcacccctgctgtactgcaaaaagggtctgagagtaggaccttattcagatgggatgggccatgtgcagttatgcacattcatgtccaaggtgagtgcctatgctcacttacaattgtgcaccttgattgtccaaatgtaagggtatatggagtggacactccctggtggaagggaaaggaagattggaggtggggtgtggcaggggaggctttcatgtctattacacagaaactgggataaatataatcacacacataacaggccaagaaaaagggccttggtgattcagtacccctgctgtactgcaaagggcatctgagagtaggaccttattcagatgggatgggccatgtgcagttacgcacattaatgtccaataatgtccaaggtgcatggctgtggtcacttataattgtgcaccttgattgtccaaatgtaatgatcttatggagggggcactccctgctggaagggaaaggaagactgggagtgggggtgggggcggggggaaggcttccttgtctaatacacaggaacccagacaaatataatcacgcacataacaggccaagaaaaggggccttggtgatcagcacccctgctgtactgcaaaaggggtctgagagtaggaccttattcagatggaatgggcaaagtggttatgcacattaatgtccaaggtgtatgcctgtggtcacttacaactgtgcaccttgattgtccaaacgtaagcgtcttatggagagggcactccctgccggaagggaaaggaagattgggggtggagtgtggcaggggaggcttccatgtctaatacacaggaaccgggacaaacataatcacacgcataccaggccaggaaaaagggccttggtgatcagcacccctgctgtactgcaaaaggggtctgagagtaggattttattcagataggttgagctgtgtgtagttatgcaaatccatgtctaaggtgcatggttgtgttcacttaacaattacgcaccttgactgtccaaatgtgagagtcttatggagtgggcactccctgctggaagggaaaggtgagactgaggtatgtggagaggaccctccttttctagtgcataggatcccagacgattataatcacacacaacatgccaagaaaaggggactgcgttatcagcaacccttctgtattgcaaaaggggtcggagagtaggaccttattcacatggaatgagcagtgtgcgattacgcacataaatgtccaagatgcatgcttgtggtcacttacaattgtgcacctagactctccaaataaaagggtcttatggggtgggcacttcctgctggaagggaaaagtggggatgaggggagcactttccttctctagtgcatagcaacctcgacaaatacaatcacacatattgggaggccaagaaatggggccttaggtgtcaccaaccatgctgtccttcaaaaggaaggatactgatgtaattgtcattaggcacattaacagtttgagaaaggggccttaagtgaatagtaccccatgcaataaagcaaagagggtgtgataggtcagaaacccaagtctaattgaaggaccattgacaactgcaattacatgccatctacagttcgaagagaagggcttaatattgattagcactctctgctttgataagtacaggagtcctgataaaaggcacaactgtatgcaactgaaaatgtgtatataacacctaagattatgcacgctaactttactagtctaagggtcttaagtagtaggtacttccagctgggatgtaaatacagtgggtggggtccttacatggtaaaaaagtacagcagcaaatataagtatgcacattaacagtccaagagagtgaattcaggctagttagaagctcctgcagtaatgcaaatggagcaaggaagcgggattctactctaacataggggcacatcaactactgctaattatgcgcatttaagcagtataagagaagaagcactagctagttagcactcctgctgctttgccaaggaggtgtgagggggatgggattccagggcaattgtcttacttttttttttttttaatgttggccaggctggtctcaaactcctggcagtaagggatcttcccacctcagcctcccaaagtgctgggattacaggtgtgagccaccacacccggcctcagggcaattttgcataatagaaattcaagaaagactttaggaaatcagtacccccttctatgatgctgagaagtcaagatattagcttgatataaaagctagatattagcttgatataaaagactcagttctaatcaattagacatttgaaatgtcttagacaattgaaatcaattaggcaattgaaaatatgcacattaagagtcatggataattagaaatacacattaagagtcccaagagaaggactctgggtttccagcatccctttctataatgtaaaaggggtagaatataggtttaaagggagagaccatgaacattggaattttgcacattcatagtcccagggaaaggtaacataggtaattaatatcccttgctgtaaaacaaggaggataaaatggatctgatctgaaagacattgttgtgatcagttgccatggttcacattaactatcctagtgcaaaggtcttgactagaggtcatccactgctgaacactagggaagtgagtggggtctttagtgcacaggaagagggacaaatgcaagtagcacattaacagtacaaaagaaatgtccttgtgattagcaccctctactgtaatgctaagagggtgtgagcagttgggatcttaatttaatggaaaagaccataattgcaattatgcgcattaacagtcccaagtaccccctgctgtaagacaaaaggaatatgaggggatgagaccccagactaacagcagatagggaaattgcattttgcacatcaataatttctggaggaggggcattaggtaaccagcaccctcttgatgtaaagcaaagatgatgcagggaccttgatataaaagactcagttctaatcaattaggattgtgcacataaactgtcctagtacagaggtcttgagtagtaagggtcccctgctggaatacaaagggagtggaagggttagtgcacaagatcgtggacaaatacaattatgaacatcaatgcacaagaagagtccttgggtgatcagcccacattgtagcgtgcaaataggatacagagtccctttctaatggacaggactctggacaattgcaactgtgcaaattaactgttcaagagctgttattgaataatctgcactcgttagcaacatcccacagaaggtgggatggggtgagaatccatttttattgcacagaaccatgaatatatgcaattatgcatatcaactgtttaagagaaggaaacttgggtagtcagaactcagcagcaatggcaaagaggacatcctagactaatgagtgggactatgggcaattagtgttttacatattaatgcaaggtggtaggtagttcacactatctaggagcaatgataaaggcatacacataagtgggtcttctctgttacgcagaaccatgaataattactattgtatccattaatattccaagggaaggggctctaagaatgagtcagtcccactgctgttatgcaaagatgtttgcaaaggccatagtgtaactaacagaactatggataattgggattttactcaataatttaagaaactcttaaatctcaggtagtcagcgctgcctcaaggcaaatgcaagggcgactggtagtcttcatgattaatgggtgagacaattagcaattactactttgttctttaattgtccaagaacagcaggattctccagaagcacagcaaaaagcgcagtagggtgcctttgtttaataggcaaagctatgacaattgggactgagcattttaactgtccaacaaaagacgggttgtctgcgaccccctgctgaatgcaaatggggttcagagtgctgtctaatccaatgggtaggattattggcaattagaattttactcaatgcaaagagttttaggtggccaacacagtacacaagaaaagatcactactcaaaattgggactgtgactacagaagcaatgacagagaaatggtttctcctttaagggcaggggatcgagaaaatgataagtaactcaaattgtgggcaataatgctctgatagaaagctctcaattgacattccctaacttcaacgtaccgagtaaggaaattctttgtcctgagatcacagacaaatgggattgtatgcattaactgaaaatggtcaaggagtcagtactgaagatcagcaatgccaagggtaaacggaatatcccagtataataggataagcaatggacaacttattttgagcactgaatcaatgaaaattagagtgactttcgagagaagctgggcgggactgaggaactaggactgggactggggctagggctggggggttaggggactggggctggggcagggctggggcggggtgggagtagggctggggctagactaggggtttgctgggagcagggctggggaggaactggatgctaggcaggcaggatacaacgaaaaattgaaatactccaatataataagtctgaatagaggacaccagaccacagcaattcaagtttcctgtctgataagtaggtgattagtcaattagtgcagcatcaaggatgggaacaaagcaaggcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttggccaacgatcatctgtgatccattctggtccttgccacggctcaccaccatgtccacaccaagcaggcctggagcactgcccatggcaacagtgcagtgcagggcagaccagaggggggtaggggggtaggggggtaggggggtggggaggtggggggtggggggtgggggtggggagttgggggggttggggggtggggggggaggtatacttagccttaggtgaggcaccaatacagaggaatggagggaggttcagaccacacagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaagcaggtatccgaagccccgatgggccaaaaaaagaaaatttttaaaaagcagatatccgtcaccccgatgggccagagtgttgggggttcagaggggaagggaatcagcaggtatccgataccccgatgggctaaggaaaaaaaaataaaaagcaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccagccccgagagagtaagaaatatggctgcagcagcgaattgcagcgctttaagaactgaagggggggctgagggcggagagagcataagaggcgtggcctagaagattgaaagccggacatctttgtgatttggttggttcaaaatttacccagtaaggacaaaaaagggaaatttcaagaaagcaaagacataccagaaagaacattaactggaagtagacttcatttctagaccaggagtcacaacttcaatgggttttccagttctcatctataacatggggacattgagtaaatcaagcaataattaatgctaaaatcctccataaactgcataataaatgtaaagatgttaattcagcttggttttgagaatgggggaagggataggtagagctttgatgtgttgataaagtatccaaatatatcattcaaaccagaatttgtaactcctccaccaaacttttgaaccaaagaagctagaaaggagtaatacattgaggttagtaccatcttcaagggacttcccattccattatcccatgtaatagataatggaatatgtattgcatagataataataaaggattattcctgttttatacattaaaatagagtcctatagaggttacatcatgtgcccgaggtcacacaccatgattcagagtcaatgtagtttttactccaacactctaccttgtatggctcccaaccataagagaacggaagtgcttacgagtcaattggtgagcaagagagaaaaaggaaagaaagacatttcatagaatggctatttggttcctaaataatcaagaaagagtactgtttgtgacctgtttgtaattttttaactatgactccttaatctttactattttcctatttcctccatgaatctgaggaacccaacattggaccaaccatatgacacagtagtgaagttgaccctctgtcagtaactgataagtggtaggaagaaaaagctcatataaaagccaaagctgccctcagaaacctggctatttcagtaggaagcaattaatctcataaactcttctatgtcattcgagaaacaacagagaaccagaagggagacaatggcaacttaagtattatagagcaacttctagaaagtcaaaggatacattaccctcccactggctgaactggaaagtgtaactatcgacccaaatctatcaggtaagcttgctcttcagtttccagaaaaataataaagtatgcaaattttcttccttaagaaataccttccatcttctaagtgtccttggatcaaacaaaaaaagtaatctgacttgtcattccaaatgagggttattgtattgtaaagtggtgcaatacaatggtacctttgagaaaacaatgcttaacaaagagagaaactacctacagtgacacctatgaagcagctatcagaaagactggattaccaaacctctaatacaactttatctactagaagtttctacaagtgtggaaatgttctatacttttaagaaatttggttggccgggcgcggtggctcatgcttgtaatcccagcactttgggaggccgaggtggctggatcacctgaggtgaggagtttgagaccagcctggccaacatagcgaaaccccgtctctactataaatacaaaaattagccgggcatggtggcaggcacctataatcccagctacttgggaggctgaggcaggagaatcacttgaatccaggaggcggaggttgcagtgaaccgagatggtgccactgcactccagcccgggcgacagagcaagactccatctcaaaaaaagaaaaaagaaatttagttggggaaaaattttctaaagactcaagtagcatcaaatataaaagattgataaatttgactctgaaattaaaaccttttgtttcacaaaaataccttttcaaataaaaaggcaaaaagacaatttataaactggttgtcctgggtttctgtgaccaggccctggttccaggtgggcagccacgctagcagatcactctcattggttgtcattggagttttttaaatggtaactcttaaggctaggcatgcaaaatggtgctgatgtgccgttatggggtgacactcacattggacacaggacatgttcagagctgtggcctacctaaatccactgttgacccttaggctaaagaaactgcaaaagcaagaaatttataatttcaatacaaagaggttccagagtgccattgcaaaaatggaagtagtacagtgttgctatgtttttctcatagagggagatgtgaaattagccaggaatggtgcatttgacaataaacacaaagagatgatttctggacctaaaaaggaagatatggtgcaaggtcattataaaaattgatatgtgaactgttgaataaacaaatacgtaagcatctcttctccacctggtattctaaattttcattgataaatcactacacctcacatgggcccatgtatttgtaatatatttttaatcaaactgtttacattaaaaggaacttctgaaaaatatttgcctaggcctttgccctagagcagtcctgccctcttctgccatttatcaccttcaggttttacttactcccctgccctcactagctttcaattcactttacttcctcctcttcccgacctggcctcaccttcactactgcttggctccattttataaacctgttaggatcagaagtatggaaactgagacactagaaggaaaagtgacttgctcaaagtcaattagctagtaagagttgggctctgatggggatatttcaggcatattttctgtggccatgccatagctgtgttagcatcctcttctttgggctcccaatcacatggcacacaataggaagaaatcaggtcctctttttaaagattcagattattccagttctaggattgtcactatgttcatctgtacatcctctcctctgctaaattaggcccaaaaaaagccggcactgtcgacttagccaccagatggcagcataaaatcaccaaagaagcactgagcctgtctgcaggaaaggagccaaagttgtatacagggcaggaccagaatctgatataaaggggggaaagtctgattcatacaaggtcagtatcagaagaaagggtcaaagaaaagtgctcaaccccctctaatttgaagagcccctccccccactaaacaggagtctgtccttggcttcagggctatgccatttaaagaggactttgataaagccttcaggatctaattagcaggctggtgggggccctccaaatcatcaccagtgaaaagcagttaaagggaccaggacatattatggaaaagaaaataaaagacctggggaagggctctttacaactcaaagggctgtctgcaatgggggaagttgatgaatagtcctgttgtgtgtagttctaataaataaagacgtctgaatactctgagctgtccaaagatggaacagttaacacctccagaactggtgaatgccagtctctgaagacctgcaagccaatagtggattttgtgaggatgctacagagacaatcaacagatagaaaagttgtgctatatgccttgtaagggtcttccaaatagccccaaatcctatgaacctcatcacagtacttgggccattcctctagccctcaaacacactatttatgatatccttcaaaagtgtattaggatgttgggaaaggttttctagtttatcaaaagagaacacggggttatacatattaaagctcagtgagtatatgcttaacaattgtatacatagttcacgtcaacattaaaaatactgtaaatgggctgggtacgttggctcacacctttaatctcagcactttaggaggccaaggcaggaggatcttttgaggccaggagttcgagatcagcctgggcaaaatagagagacctctgtctctacaaaaataaaaaatataaaaattagccaggcgtggtggtgcatacccgtagttctagcttctcaggaggatgaagcaggaggattgattgagcccagtagttcaaggatacagtgggctgtgattgccccactgaactccagactgggtgagaaagcaaacgctacctcaaaaaaaattacaatctattaaaaacatcaccagtggccgggtgcggtggctcatgcctgtaatcccagcactttgggaggccgaggcagacagatcatgaggtcaggaaatcaagaccatcctggtcaatatggtgaaaccccatctctactataaatacaaaaataagctgcacatggtggcacacgcctgtaatcccagctactcgggaggctgaggcaggagaatcgcttgaacccggaaggcggaggttgcagtgagctgagaccgcgccaagcctggtgacagagcaagactccatctcaaaaaaaaaaaaaaaaaatcaccagcaaacactagggagagggaggaattttatttcccaaggtatcacattataatattaaaactgtgcagtttttattaaaaaattacaaggcatacaaaaaacaggaaattatagctaatatatagaaaaaaaggtaattaacaaaaaatggtccctgagaaagtaccaacattaaacttactagacaaggattttaattaattaattaatgtgcttatttattttctcatttttagtttttctagtagttctttttcaaatgtatttttagttcacaaataattgtatatattcatggagtaaaatgtggtattttgatatatgcatgcattgtagaataattaaatcaagctaattactatatatctcagctcacatacttattttgtgatgagaatacttaaaatttacttagcagtttttgaaatgtacaataccttatcactattgtcatcatgctctgcaatatatctcaaaaacttattccttctctctaactaaaatttttatcctttgatcaacacatttttaccctcccttcagattattaaccaccagtctactccctacaagttcaagttttgaaaattacacatacaagtgagataatatagtattcatctttctgtgcctggcttagcataatgtcctccaggttcatatatgttgttgcaaatgacagattttccttctttttaaggctgactagtgttccattgtgtatgtataccacattttctttatacattcatctgttgatggggacttaccttgatttcatatcttgactattgtgaataatgctataataaacataggaggacaaatgtctcttcaacacactgatttcaatttctttgaacaacacccacaagtgggattattggatcataaggtagttgtatttttagtgttttcagaagcctccatgatggttgaactaatttatatttccaccaacactgtataaatgttcccttttctccacaccctcaccaatccttaacttttgtcttcttgaaaatagccattctaacaggtgtgaggcaatattgcattgtggttttgatttgcatttttcttttttttttctttctttcttttttttttttaatttttatttttttgagacagaatctctctctgtcgccaaggctggagtgcagtggtgtgatcacggttcactgcaacctccacttcttgggttcaagcaattctcatgcctcagcctcccaagtagcttggattataggcatctgccaccatgcccagctaatttgtatatttttaatagagacgggggttcaccatgttgaccaggctggtctcaaactcctgagctcaggtgatctgcctgccttggcctcccacagtgtgatctgtaatcacactgggattacagatgtgaaccactgcgcctggccttatttatttatgtttttagacacagtctcattctgttgcccaggctacagaaagtgcagtggtgccatctcggctcattgcaacctctgcctcccgggttcaagtgatcctcctgcctcagcctcctgagcgggtgggattacaggcacccaccaccatgcccagctaatttttgtatttttagtagagaagatgtttcactatattgggcaggctggtcttgaactcctgacctcaagtgatccacccgctttggcctcccaaagtgctgggattataggtgtgagccaccacacccagcctgatgtgcatttttgtgatgattattgatattgagcactttttcatatatctgtttgctatttggtttttgtttgattgttttttgtttgaggcagagtctcactctgtagcccaggccagagtgcagtggcacaatctcggctcactacaaccactgcctcccgggttcaagtgattctcctgcctcagcctcccgagtagctgggattacaggcgtgtgccaccatgcctggctaatttttgtatttttagcagagacggggtttcaccatgcttgccaggctggtatcgaattcctaacctcaagggatctgcccaccttggcctcccaaagtgctgggattacagatgtgagccaccgcacccagcctgttggccatttctaagtcttattttgaaaaatgtctatccaggtcctgtgcccattttttaattgagctatttgttttcttgatattgagttctttgagttctttctgtatactggatattaaccccttactggatgtatggtttacaaatatattctcctattccaaaggttgtctcccactctgttcattgtttccttgcctatgcagaagctttttagttacatgtaatcccatttgtctattttcacttttatttcctctgcttttgtgttcatatctaaaacattattgcccacaccaatatgataaaactttggaaccatgattacagtgtaagagtattctgaatttgaccatgtgtttacttttactggtaagttttatactttcatatcttttcatttcattcattaatatcttgttctttcagattggaaaactttgtttagcatttctaaggcaggccttgtttgatgaattccctcagcttatgtctgggaaagtttttatttctcattcaattctgaaagacagatttgctgattatagtagtcttagttgacagattttttactttagcacttagaatatatcctcacactctttcctggcccgtaaggtttctgctgagaaatctaatggtagccatattaaagcttccttgtatgtgatatgcttcttctgctgctttgagaattctttcttagtttttgaattttgatagtttgattgtaatgtgtcttgatgaactcttctttgggttgaatttaattgcatattcctgagcttcttgtaattcaatattctcttttcccagatgggaactttttggccattatttctttaaataagctgtctgcctctttcttgcactcttcaccatctgtagttttagtatccaaatagtagttttcttggtggtgtcccatagacctgtaggctttcttaatactttttcattttttttctttttcttctctgactggatgatttccaatcatctatatttgcattcagttatttgttattctgcttgatgtaatctgctattgaagcatctttggtattttttacttcagtcatcatactgttcagcttgaaaatttatctggttcttttttcaagttttgaatctctgcttaccttcttgttttgttcatattctgtcttcctgatcttttaaaaatatttgtttttttgtaatttgctgagcttctttagaacaattattttgaatactttgtcaggcaattcatgtacctccaattcttcgtggtcacacactggaaagcttcttgtgtttttctggcaatataatgtttccctgattcttcctcatccttgtagtcctgcaaaggtgtctgcacttttgaagcagcagtcacctctttcagacattatggcctggctttggcaaggaaagccctttacctaaggaggaaaaagggagacatactaggtgcactgtggcactgggtctagaccataggaaaccaaatgcaggggcatagtgtggctctgggtctggtggtgtggcggcagataggggccgagtctagtcagctcaggcatgcctacaacattggcaactgcatggtcctttgtgtcaagagctgtgggagtttcgcaaagattatgagggctgttggggtcctcagctatgtatatgtgacaaacagctagggtctgggactggcagcagtggaggccagagctgaaagtgtacacatgctccactgtggagtctggttgcagcagcagcctgttgtagtctcacacatggtagcaagagcttgggtcatatgccgaagctgggcctgaatgtgagcatagatgtggtggtaggtgctgcaggttgcccatgcctgatcacaagggccagatgcatggtggcaacaggggtcaggctgtctgcatgtgtgtgtttgtgtgtgtgtggcaactgcagggctcaactggaggtgggtaggcatgtgcagcatggtgataaatgcaggacccatggggcaggaccagtggcttatgcatgcaccactacaggaaccagggctggcagcatgcagtagtcctgcagagatcagccttgagtgtatgtggggtcaatttctgaggtgaggggctttggggctctttgcaggcacaggtgcaacagctgcactgggcctctgggccagagcacccatgtaagcaacatcaggggtggctttggaaaggatggttgtcttaggcacctgcggtatatgaaggccactgcagtagtaccctgggctgggacaaccacaacagaagcagttcaggtggctttggggaggagggtggttggttaggcacctaaagacttcaaggctcctgggttgtgtcaccaggctgaggaaactgcagcaatagcaatcctgccctacatggctcctgggaatggggaggggaggtaacgccagcacctaagactatgaaggtgaagaaaactgcaaggccttcagtagcaaaagtggcaggggggttattgctggtgtgctggcatttgtttttctcagtagtaaaagctgctatgttcctctgcaggacaagctgctgggctccacaatttcaaacactgaggaatcctcagcagttaaggctgtggggtctacacagcagctccaggggctgtttgggtcctcagtggagaagtctgctgctttcccatgtcaggtaggccactgggggtcacagtaacttccaccttttggctgattctaaaagagctcatccaggccaggcgcggtggctcacccctgtaatcccagcactttgggaggccgaggcgggtggatcacctgaggtcaggcgttcgagaccagcctggccaacatggtgaaaccctgtctctaccaaaaatacacaaattagccaggcatggtggtgggcacctgtaatcccagctactcaggaggctgaggcaggagaatcgcttgaacctaggaggtggaggttgcagtgagccgagatgacgccattgcactccagcctaggcgatagaccaagactccgtctcaaaaaaaaaaaaaaaaaaaaaaaaaaaccctcatcccttgtctttgttctcagctgtctccagatatctcagctatgcaggttacccccagagatctgggtggggtgaaactgaagctagtcatataggcagtgtcctaaaatactggcaaaactggttctataccttgctctgctttgtcttgcaaggcaaacttaagctagggaggtccctctccatgctgagcagtgtcagcatgaaggatgcagtgatggaggtgaaatgaacttgttcttattaccatttttgtgtggctcttcttgggttttctcttctactgtattgttgtgtcaccttaagtggatcctagcctcttccagagatattttggttcatggatagttgcagaattgttcttcacagggagaggaaggctgaatctcctactctgacatcatgctgacctcactccactagacaaggagtttaaattaaatatttcaaatatgctcaaagacataaaagaaacaatagacaaagaactaaaaaacacagagagaataatgtctcaacaaacagaaattatacattagaaatagcacttataaaaaggaaccaaatagaaattctggagctgaaaatacaataactgaaacaaaaaaattcattccaggcattcaacagaaaatttgagcagccaatagaaagaaacaacttgaataggtcaattgaaattattcagtctaaggggcacaaatacaaataattaagagaaatgaagagaatgtgagggacctatggaacaccatcaagatgccaacacacacattatggaagtttcaggaggggatagagtgaactagcattaaaaaaaagggagaaataatggttaaaaaaacttcccaaatttgataagacacattaatctacacattaaaaaaacctcagtgagccaggccaaccccaacagccccaggctccagaccagctcaccactaggccagcccccacagtcccaatcttcagttctaccccagcaatcagctgttccctgcaactctagtcattaggctgacacccacaaacccatctccaggccagcccctgtggtgccaggtttcaggcttgctccagcaccatgtcagcaatgctggacttaaacaccaggcaggcacccacagacacaggctccaggcctgcccagcaccaggccagtccccatgacctcacactctagctggaccctgtggcttcatagcttcagcagacccagggtccaggcctgtcccagtagacccctgtgctggatttgccactacagacacaagcttaaagattgccccagtgtactcaggtcacaggaaccctcaagtcatccaaacccaggccagccctcacagtcttagcctctaggccagcacctacacacccagcctccaggctgggacaagtggacatgagctctaggctgagcctgacagccccgtgcttaagaccagccccaggatctccaggcacaaagtcagttcccatagacctaggcttcagactagaccctgtgaacccaggctttacaccagccctagcaccaggttagcctaggttgatcccagtggaaacaggctccagaaaacacaagatccaggcttgttccagcagacgcagggtcaaggcccactgtagtagacgccaatggcgggctagatcccatggactgaggcttcaagactatatctgcagacataggatccaggccaggccctgtgggcccaggacccagacctgcactatggactcagggtccaggccagccccagtgccaagccagtgcttgtggactcaggctccaggatcatcccagcacctgcccagcccctgtagatgtaggtctaaggcccaccccatcaagtgctagatcagcctctgtggaccaggcttcaggcttgcctctggagacacaggtctcagcctcagactcatggacccaggctctgggctcatcagtgcagtcccaattaacaggttcacccaagtggatgcaggtccagactcaaccctgcagtttaggagtcaggcctgtctacctactgacccaggcgtaggccagcttgttcaaggactccagcaacaaggttttcttcaaatcacgcctgagagcctgccaagaatatttggatgagctgattggtgaagggctttcccaggcaaagcattctataaaaactgaaacaagtcccaaattgttcaaatccacagacatcaacttaaggcaacaagaaacatgaaacaccaaggagacataacatcaccaaaaaaacacaataatctctcagtaggccgggcacggtggctcacgcctataatctcagcactttgggaggccgaggctggtggatcacgaggtcaggagttcaagaccagcctggccaagatggtgaaaccccatctctactaaaaaaaaaaaaaaaaaaaacaaaaattagccgggcatggtggcgggtgcctgtaatcccagctactcgggaggctgagacagagaattgcttgaacctgggagttggaggttgcagtgagccaagatcgtgccactgcactccagcctgggcaacagaggaagaatccatctcaaaaataataataataataataataatctctcagtagctgaccccaaagaaatggagatgtacagactgcctggcaaataattcaaaataattatttaagaaagttcaggctggcgcagtggctcatgcttgtaatcccaccactttgggaggctgaggagggtcaattgctttagctcaggaattcaagaccagcctggacaacatggtgagaacccgtctgtactaaacatacaaaaaaaattagtcgggtttattggtgcacacctgtagtcccagctacttgggaggttgaggtggatcacttgagccctgggggtggaggttgcagtgagctgagatctcaccactgcactccagcctgggtgacagagtgagacctacccagtctcaaaaaaaaaaaaaaaagttcaacagcttaaataaaacaattaaaagtaataataatgactaaaagaacaaatttaactgagattgaaattaatttttaaaaaaatcaaacagaaattctgaagctgaaaagtaaaaggaatgaaatgaagaggaaatctgtgaactcataagactagcaatttgaaaatatatcatcagaggctaaagaagaaaaggaatgaagaaagcttacttcatttatgagataacatcaacagaacaaatattcaagttatggaagttcattaaagagaagaacaggctgggcgcagtggctcacacctgtaatcccagcactttgggaagccgaggtgggtggatcacccgaggccaggagttcaagaccagcctggccaacatggtgaaaccccgtctctactaaaaatacaaaaattagctgagtgtggtggcaggtgcctgtaatcccagctacttgggaggctgaggcaggagaatcgcttgaacccaggaggtggaggttgcagtgagccaagatcactctattgcactccagcctgggcaacaaaagcaaaattgtgtctcaaatgaaaaaaaaaagagagagagagagaaagagaagaacaaaggggaagaaagcttatttaaagaaataatggcagaaaaaaaattcaaatttggagaaagatgtaaatatccaaatacaggaaggtcaaaagtttccaatcagattcaatccgaatgtaataagactacatcaaaacatattacatattataatgaaactgtcaaaaatcaaaaacaaagaaaaaattataaaagcagcaggaaaaaagaaccaaataatatataatggtttttccaataaggctagcagatttctcagcagagaccttataggccagaagaaacttggatgagatgttcaaagtgcaggaagaaaactgccaaccagcaatactgtacttggaaaagctgtcctttagaaataaagatgaggttgggcacagtggctcacacctgtaatctcagcactttaggaggccaaggcgggcagatcactagaggtcaggagttccagaccagcctggccaacatggtgaaaccccgtctctactaaaagtacaaaaaatcagccaggcatggtggcacacgcctgtaatcccagctactcgggatgctgaggcaagagaattgcttgaacccaggaggcggaggctgcagtgaggcaagattgtgctgctgcactccagcctgggcaacagagtgagactccatctcaaaaacaaaacaaaccaaaacaaaaataagtgaaaggtcaaatgctctaatagtgtaatggtggtggtttgtgaatcatttttatttttagtatgaaggttataagacaaagctattaaaataatagtagcaccttgggaggctgaggtgggaggctcgcttgagctcaggagttcaagaccagcctgggcaacataaagagaccttgtctctacaagaaaatttttaaaaaattagatggaatggtggcacatgcctgtggtcctagctacttgggaggctgaggtgggaggattgcttgaattcaacaggtagagtctgcagtgagccatgatggcaccactgcactgcagcctgggtgacagtgagactctttctgaaaaataataaaaataataatagctacaataatttgttaagggatacgcaatataaatatatgtaaattgtgacatcaaaaattttaaatgagggagggaacagaataaaatgtaaagtttttgttttttttgtttttttgtgtttttttgagacaaggtctcactctgtcacccaggctggagtgcagtggtaaaatctcagctcactgcaacctccacctcctgggttcaagcgactgtcatgcctcagcctcctgagtagctgggattacaggcacatgccaccatgaccagctaattgtttttgtattttttggtagagatggagtttcaccatgttggccaggctggtctccaacctgacctcaagtgatccgcctgtctcggcctcccaaagtgctaggattacgggtgtgagtcaccgcacctggcaaacgtagagtatttttatgtatctaagataagctgttatcagcataaaatagactattataactataagaagccttatgtaagcctcatggtaaggacaaagcaaaaacctatagtagatacacaaaatataaaaagtaagaaatgagtcagacatggtggctcacatctctaatcttagcactttgggaggctgaggtgggagtattccttgatgccaggagtttgaaaccagcctgggcaacacagtaagaccccatctctacagaaatttttttaaaaattagccaggtttggtagtgcatacctgtagtcctggctactcaggaagctgaggtgggagaatcacttgagcccaagaggtggaggctgcggtgtgccatgagcatgccactgcactccagcctggaaaacaaaataagaccctgtctcaaaaaataaataaataaataaataggaatgaaagcatgctaatagataaaatcatataattacaaaggaagaaaagacaggaagaaagaaacaaaaggtctacaaaataaccagaaaataactaacaaaatggtagtagtaagtccttacctatgaataattaccttactgtaattggattaaattctccagtcaaaagaaagagtggctgaacgagtttttttatagccaaaaaaaaaaaaaaagcctcagctataggctacctacaacaaatgcacttcacctgtaggaaaacacacaaagtaaaaggatggaaaaagatattctatgcagatggaatcaaaagagagcggagtacattgtatttatattaggcaaaatagactttaagtcaaaaaccataaaaagagacaagggagatcacactataatgataaaggggtcagttcattaaaaagacataacaaatataaatgtacatgtaccagccgggcatggtggctcatgcctctaattccagcactttgggaggccagggcaggcagatcacttgaggtcaagagttcgagactagcctggccaacatggtgaaaccccatctctaccaaaaatacaaaaattagccaggtgtggtggttcacacctgtaatctcagctacttggaagggtaagacaggagaattgcttgaacctgggaggcaaaatttgcagtgaggcgagatctcaccactgcactccagcctgggtgacagagcaagactcagtctcgaaaaaaaaaagtatatatatatatgtttgtgtgtatatatatgtgtgtatatatgcatatgtgtatatgtatatatgtatgtgtgtatatgtatatatgtgtatatgtatatgtgtgtatatgtatatatgtgtatatgtatatgtgtgtatatatatatatatgtatatacacacacacacgcacctaacattggagcacttaaatatataaagcaaatgttaatagatctgaagagagagacaaactataatataataaaagtagggaacttcaataactcactttcaacaatgaacacattctatagaaagtaaatcaatgaggaaacataggacgttgttttgagaccccccagttaaattaaggttccagtactagagtggctagcaaccttgacctaggggaacatgaaagggagttagacatgggtgtttacagtgtgcctttcatgggatacttcttttacctggttgacagcctaatgcctagctgtctgacctgtaaccaggagagtgccctcacacaggaaacttgtttatactggcagagaccagatcactgtgacttttgtctgacttgtgtccaatttatgccatgcttgccatcactctgccactgggagccagacatgattttctcaccagcattctgggcaaaactcagcctggagcagccccgagttcttcaggtgaaaggtaaaaaatcaatatgtaccacaataggaaacaagttcaaagatttttacttagattctggtcaggtggccaggcatggtggctcacacctgtaatcccagcactttggaagaccgagacaggcggatcacctgaggtcagtatttcaagaccagcctggtcaacatggtgaaaccccatctctactaaaaatacaaaaattagtcaggtgtggtggcgcacgcctgtagtcccagctaatcaagaggctgaggcaggagaatcgcttgaacccgggaggcagaagctgcagtgagccgagactgcaccactgcagtccagactgggtgacagagtgagactccgtctcaaaaaataataataatattaaaataaaattgtattcaaaatggatattgaggcaacataaaattttaagaattttctacaatccacccattggtgcctcagcattatattttaagtctaaagcagctgtggttgaatggtgaagatatattaactttaaagagaaagagaggttgtggtggttatattcgcaaggtgagaaactgtggtggaaagctgggggtcgtagtagaaaaagacatcagggagtgggtagtcctcccctagggtgtcaaggggttgatgaatataggggctggtgtttcctggggaaagtactaatctccattaattttagtaacatgtatcagagtcccttgtaggtgtgggatgtgagggtaacagagagcaagaaatgtaccagaatcatgggctaagcaaaaaaagtcctgtgtccatttgtgtcttaggagaagcagtccatggacatcactagagtgcagatttagtgcaagtggggatgtcctctgcagcacagaggcagagtcattcccaacaccaacgtcttgggttgggtgatattgtctgaggcaatgtcatacccagcagtaaagttttgagttggggcaatatcctctgaagctatgtcatctccataggtgagattttgggccaagacaatgtcatctaggatatgggactgggtatcctttacaagtgggtacccactcaagtagatgtgggcctcagcatttttcatgtttacttgaaacaatcaactactggagggtttgggcctctggttctaaaccaattaaagcacccaaaccactggtaagaagaccaacgatcaacagaatagaatgcagttgcacctgatagagttttgttttaggtggaaatttaggttcaaatggtaccttatcatatgagaagctgtctggtctatgggaaaagctatggttaatgaatctgaggagagtaagtgtctttgatctggtctccagcctttatgggatgggagtaagatcaaaaaattatttcaaaaaatagattaaggcctggggcaaattagagagctttaggagtgtatttgttggactggaatttgaaaagaaattgttgccaggtgcggtggctcacgcctgtaatccgagcactttgggaggctgaggcgggcggatcacctaaggtcaggagtttgagaccagcctggccaacttggtgaaagtctgcctctactaaaaatgtaaaaaattagccaggcatggtggtgggtgcctgtaatcccagccactcaggaggctgaggcaggaaaatcacttgaaccctggaggcggaggttgcggtgagccaagatcatgccattgcactccagcctgggtaacaagaatgaaactccatctcaaaaaaaaaaaaagaagaaaaaagaaattgtttgaagatatcattgtatctcccaattaaatcagttatttggaatctatcttttgttttattttttattttattttatttatttatttatttgatactgagtttcactcttgttgcccaggctggagtgcaatggcatgatcttggctcaccgcaacctccgcctcccgggttcaagcgattctcctgcctcagcctcccgagtagctgggattacaggcatgcgccaccacacccagctaattttgtattcttttagaagagacagggtttcttcatgttggtctggctggtctcgaactcccgacctcacgtgatctgcccgcctcagcctcccaaagtgctgggattacaggcgtgagccactgtgcccagttattatttattttattttatttttttgagacactcttgctctgccacccaggctggagttcggtggctcaatcttggctcattgcaacccctgcctcctgggttcaagtgattctcgtgcctcagtcacccaagttgctgggactacaggcgtacaccaccatgcctggctgatttttgcatttttagtagagatggggtttcaccatgatggccagggtggtctcgaactcctgacctcaagtaatctgcctgcttcggcctcccaaagtgctggaattacaggcgtgagccaccgcacccagtgaaagcctttatttctaggacaacccagttagccagccatgtgttattttaatggtgcataacatgagaatttcttgcattggaagccctgaagtaactaatgactatcatgagtggtccagagattccaggaggcatgaaaaaggttgctgtgaacaagttttttgaaagtactaacaggagtgatggttaattttaatttataagtaaaaaaagacattggacttatatgtacttattgagtgtgtcagatgaatctccttgaaaaaggatgtcattactgtaatggcatacctgtgttcctggagaaaggtagatgtcatcaaaatgttatctgcaaagcctgtcccaaataagcaatctctgaggaaacttgttaaccactagatcaaccttaaaagtaattgtcaggaagttctaaacctagaaaaaaaaaaaagacatttgccatcataaaaacatgaaaggataaaactcactggtaaagcaatcatcacacaaagaaggaagaagaaaacctcaaattttaccattacagaaatccaccaaaccccaacaataagcaataggagaaaacctaaggaacaaagaatatataaacaaccagaaaacaattgacagtatgacaggaacaaaacctcaagcatcaaaaataaccttgaggctgggtgcggtggctcacgcctgtaatgccagcactttaggaggctgaggtgggcagatcacctgaggttgggagttcaagactagcctgaccaacatggagaaaccccatctctactaaaaatacaaaaaattagccaggcatggtggcacatgcctgtaatcccagctactcaggaggctgaggcaggagaatcacttgaacctggtaggcggaggttgcagtgagccaagatcacaccattgcactccagcctgggcaacaagagcgaaactccgtctcaaaaaaataaataaataaataaccttgaatgtaaatggattaaattctctacttgaccagtgaagacacatatggactaaaagagatggaaaaaaatatttcacacaaattgaaacccaaagcaagcagaagtagctatatttatatcagataagacagactttaagtcaagaacaggccaggcatggaggctcatacatgtaatcgcagcagtttcggaggccaaggtgggaggatcacttgaggccaggagtttgagacaaacctgagcaaaatagtgagaccctgtgttgacaagataaatattaaaaaattagccagatgtggtggcatgtgctactcaggaggctaaggtaccgaccatttatgcccaggagttcaaagctgcagtgagccatgatcacatcactgcattccagcctgggcaccctgtcttattgttattatataataacaaagggatccatccagcaagaggatataataattgtaaatatatatgcacctaacactagagcaccaagattcataaatcaaatattggccgggcgtggtggctcatgcctgtaatcccagcactttgggaggccgaggtgggtggatcacctgaggtcgggagttcacgaccagcctgacatggagaaaccccgtctctactaaaaaatgcaaaattagccggggtggtgatgcatgcctgtaatcccagctgctcgggaggctgaggcaggagaatcgcttgaacccaggaggcagaggttgtggtgagccaagatcgcgccactgcactccagcctgggtgacaagagtgaaactccgtctcaaaataaataaataaataaataaataaataaataaataaaatattactagatataaagagactgtaatacaataatagtggggaaattaaacaatccattctcaacattagacagattatctaaacagaatatcaacaaagaagcattggatttcaactgcactctataccaaattgacctaacagatgtttacaaaacattctatctagcaactgcagaatatatattattttcatcagtacataaaacatcctctaggatagaccatatggtaggccacaaagcaagactccacaaattttttaaaaatcgaaatcatattgggtatcttcttagaccacaatggaataaaactagaaatcaataccaggaggaactttggaaactatacaaatacatgtaaatcaaacacaatgctcctgaataaccattgcatcaacaaagaaattaagatgaaaatcaggttctggttcaagatggctgactagaagcagctagtgggcacctctctcatggacaggagttaaaatagtgagtaaatactaacatttcgagtggatcatgtaagagagcatgctgaaattcaccagagaaacaataggaaccatggagaacacaggagaatgaagctaggcactgtgcttagccaggatgggtgtggagctaggagaggcttcctaacatgggagacaggtgagtgagtgagagattcaaggggttccacatctccaacacggaccattacaatccaagtcatggaagagcccccttgactccccttaggtctccagactaacacagggagccacctggagactgagcagaggtaccactcaagcccacgtggaattcaacagacttttgatccccaagcagccttgagccaggtgctgctgccctggccaaggagggaggtcaggcattttcacatgctcctaggagagataccatggccatggtaagaaggaatgggtacatgacaaaccatatggctcccacctctgctgcaccctgccaaacagggcttgcctgcttttggggcagaacaccaacaaaccaaccctgcccccaccttaacattgcaggcacagttcaactcccaaaggcccccagctcccagaagccatctaaaggccctctgtagcctctgctactgcgtccttaactcctgccacccacaggccagggaagaaatgaggagggaggaaacttttgtgcaccccagtcatgatacagaggagtggtcaggctgcacattgcatgatccctcacctccatggctccccaccagacatgatatgcctgcttcaatgaaagtctcccagcacagcacaactgccctgctcttgcctgaacactgtggctatatcttggcattcctctgagggcccaaatcctagaggtcactgttaggcccttccaagttgctgccactgctgcctctgctcctgctgcctgcaggccagggagggaatggggaggtggggcaatattgaacacccctaagacagaaccaaggctcctcaggacttagcatgtccttctaggattgttttggaagggaccagctgtgcagataccatggaggtggtactgatctttgtatacagcctgctcgtcccggtggtcctggccagtgcagctaaggagaaggaaatagatccttttcattataactaccagaccctgaggattggaggattggtatttgatgtggtcctcttcctggttgtgagcctctatagagtcttgctctgttgcccaggctggagtgcagtggcaggatctcacactgcaatcactgccttctgggttcaagcaattctcgtgcctcagcctcccaagtagctgggattacaggtatgcaccaccatgccccgctaattttgtatttttagaagagacagggtttcaccatgttggccaggctggtcttgaattcctgacctcaagtgatctgcccgcctcggcctcccaaagtgctgggattacaggtgtgagccaccgtgcccagccgagctgccatcttctaagtcacaggtgcaagtgcagtttcaatcagaagccccaggatccaggagataaggaagctcaggtggaaaacttcatcactgcaaatgcaaaagagccccagaaagcaaaaaactgaagtgcagcccacaggtaggcagcctctggaactggaaggtagctgcttgaacctttagatgcaaatatcgatgcttaagaaaaccggccactttagcaacagatattttcccaggagaaggcaagaacttgtgcatctccctgtgcccatccctatctcttctaacaacattcttcaacctaatgatgcaactaacatttgcctccctcatgcagcctgtggtcttgcccagctcctgttacgtgtctgtgtatgtgcgtgtttgtcgactgtggtctttgtggctacttgttcatggatgatattgtgttagtgaactgtggagactcacttttccaggcaggagcggagccatgtcaccactgatccctccctgccaccacgagtctccatcatctcctgcttctaggagtccacttattccctgagagaccaaccccttttgttgatttagggatgggtttgggtaggagcatgggcaggaatctccaattatcctaggacctggggaggtttgcatcaccgtcattatagttcctcatggaccctcttcactcctctacaagaaactcgcttccttatttcaccctcacatgagtctatcctgaaggtctcttagtattaataattggagattcaaagcaagaagctggtgagcccagccattgccttcaggcaagctactccctttcatgatcatttttttccaggaggcctccactgagaagtctgcatcaaccctgcccttctgcagagttcccagtgattttaggctaagggcttctactctacccctggggaatgtgacccttgcgtatcttctcagcaataaccccatgggctctgggactgtacccctcttcaaccttccctgcttctgagatttcaatctacaagccagctcatcaggatgcagactcctatccctaaagttgggtaactggcaggtgatggctgagggacccccattctgttggggccaacacactgggatgggcagagtgagagtaggggtcctttgattctctgcccatgttcccttggtcagacaacagagacaaatcctgcatcctttgctttgcctgtcagtattcagagttgtgagtgaggaaggttagagatctggaagactctgtatagccctgctgcagagggaacagcaagaggtcagaggttacaataagaacagtaactcaaaccagtttctgcccctactgtcctccatgttcctgtggaaaccaaactgctgctatgaccatactgctgttctctctattgtgatctatcctctcaacaacagaaaaaagacataaaatattgtttccaaaagaaagacacaacctgcagccacaatgcaaaggagcaggcagaatacacacagtgtgaacccatgcttccatggctccatgcaagctaaggcttgcctgtttcagtaacaggccccacatgtacctgccccacccttgcctgaatgctgtggctttgggtgaactcccagaggctgccaactcccagaggccgctgataggccctccacaccctctgccactgctgcttctgcccctgctgcccacaggccagggcagcaggcaccttcataggccccaacagtgaaatccagaactgcttctgtggaggaaagtgcaagcaggccgcatgctccacagctgccagtctttactgcctcagaagagggggcctgccctccccagtgaaagtctgacagcacagctaccctgctcttgccagaccatttcaactgcagcccagcccccataagcctgttgtctccctgcccctgcctaagagttctgccagtgacccagggaccagactaccattctcaatcacatcaagcacctgaaatgtgggctgacacagtcctggtccagcccctttcagactcatacatgacattcaatgggccatataggggcctgagaatagaggagtcatctactctagtccaccactgctggcacctgaccacccccacccccagggtcggaggttggaccagcccaaccagccaatatcaccacaactgacacccacatacacaggccaaatgacagagcccctactcctttctacatgaagcagcagggttgctccatcagagaacaggcaagccataaatctgtctgtattgagctgagtgaagaggttccatccccaaaccactccagtggagaactgtgagtcaggtaatttccatggctctcagctacactgtggcctggagatagaaaacagtgcatctgaaaggagagtcattagcaccaggacaggggtgtaaaggagaaacagatcacattcctgcatatctagggtgtgaagtcagtgcagctcccttaccccctgcagagaccttggtgcatctcactaggagctcccccagccaccccagtcagggctggtgccttcacttgtcattgggatatttatgggcaaggcagggctggtgcctttgcttgtcattggggtatttatgggcaagtcaggagtgattacatacacagcagcttgtgccccagctgggtctttgttagtgccacttactggcctgcaggtctgactgcacagcccaatgtaaaacctaataacaaaagtgcacaaccaaaggcaaagaatttacccaacatacactacagttacactctctagaggaaatatatatatgtgtgtgtatatatatatgtgtatacacatatatgtgtatacgtgtatacatatatatgtgtatacatgtatacatacatatatgtaaacatacatatatacgtatgtatatatacacatatatacacgtatatacgtatatatgtgtatatacgtatatatgtgtatatatacgtatatacacgtatatatgtgtatatacacgtatatacacgtatatacgtgtatatatgtatatatgtgtatgtatgtatatatgtgtatatgtgtatatatgtgtatacacatatatacacatatgtgtatagatatatagatgtgtatagatatatagatgtgtatacacatatatatgtgtatagatataaagatgtatatacacatatacatatatgtgtatagatatatagatgtgtatacacatctatatgtgtatagatatatagatgtgtatacacatatatatatgaaaaaaatcccacctgaatgaaaataaattcataaagaagtggcagcctctctagatgagaaggaaccagcataagaattctgtcaccatgaaaaatctgaatgttgtaatgccaccaaaggatcacactagctctctagaaacagtcactaaggaaagtggaaactcaaaatgacagataaagacagataaagacattttaaagataaagacagataaagacattttaaagataaaatgacagataaagagatcaaagcatggttttgcaaggaagttcaatgagatccaagagaagattggaaatcaacacaatgaaaccgtgaaagcaatccagaaaatgaaggaggatattaatatctttaaaaaaaaaacagaacttctaaaaatgaaaaattcacttaaggaatttcaaaatgcaattgaaagctttaacaatagactagaccaagcagaagaggaagataggtttttttttttttttaattttatagggatgggatttcacaatgttgcccaggctaggcataaactcctggacccaagagatcctcctgcctcagcctcccaaagtgctggcagtacaggcatgatccaccacacctggcaaaagataggtctttcaaattaacccagtcagacaaaaataaagaaaaagtaattttataaaacaaacaaagcctttgagaaatatggaattatgtataattcaagaaaacttccttcacctttctatggaggtagacagccagatacaggaaattcagaggacacctatgaaatactatacaaggggaaacattagcaaggcgtatagttatctgactatccaaagccaacactaaagaaaaaaatcttttttttgttttgtttttgttttttgagacacagtctcgctttgttacccaggctagagtgcagtggcacaatcatggctcactgcaacctctgcttcctgggttcaagcgattctcctgcctcagcctcccaagtagctgggattacaggcgtgtaccaccatgcccagttaatttttgtatttttagtagagatggggtttcgccatgttggccaggctggtctcaatctcttgacctcgtgatctgcccgcctcagcctcctaaattgctggtattacaggcatgagccaccatgcccagcccaagaaaaaatcttaaaggcagctagagaagagtcaaatcaccttaaaggaaaacccatcataccaacagccaacttttcagttgaactcctacaagccagaaaacactgtgggcctatttttaccctccttaaggaataaaaaacaagcaagaattttatatccttccaaactaaacatcacaaatgaaggagaaatcaagtctttcccagaaaagcaaacactaaaggaatttgtcacctctagattggtcctacaagaagtgttcaaaggagttctaaacatggaaatgaaaggatgataccatcataaaaggacacataaccacaaagctcacagatctcataaaacaattgaaaaattaaaactccaaaacaactaacaacactatgacaaaaacaaaatgtcatatatcaatactaaccttaaatgtaaattcaaccttaaagggttgaatgctccacttaaaatatacagagtgggccgggcacagtggcatatatatatatatatatacaaagtggcaaattggataataaaacaagacctaactatcttctgcctacaagagacccacttactggccaaagataccttcagtctgtaagtaaaaagatggaaaaagtagaatgatttataatcctttgggtatatacccagtaatgggattgctgggtcaaatggtatttctagttctggatccttgaggaattgccacgctgttttccacaatggttgaactaatttgcagtcccaccagcattgtaaaagcattcctatttctccacatcctctccagaatctgttgtttcctgactttttaatgagcgccattctaactggtgtgagatggtatctcattgtgtttgatttgcatttctctaataaacagtgatgatgagctttttttcatatgttcattggctgcataatgtcttcttttgagaagtgtctgttcatttccttcacccacttttttatgggattgtttgtttgtttcttgtaaatttgtttaagttctttgtagattctggatattagccctttgtcagatggatagattgcaaaaattttctcccattctgtaggttgcctgttcactctgatgatagtatgcacacatatgtttattgcagcactgttcacaatagcaaagatttggaaccaacccgaatgcccatcaatgatagactggataaagaaaatgtggcacatatacaccatggaatattatgcagccataaaaaaggatgagttaatgtcctttgcagggacatggatgaagctggaaaccatcattttcagcaaactatcacaagaacagaaaaccaaacaccgcatgttctcattcataagtgggagttgaacaatgagaacacatggacacagggaggggaatatcacacaccagggcctgttgaggggtgaggggctaggggagggctagcattaggagaaatacctaatgtagatgatgggttgatgggtgcagcaaaccaccatggcacgtgtatacctatgtaacaaacctgcacattctgcccatgtaccccagaacttaaagtataatttaaaaaaaatttaggctgagcgtggtggctcacccctgtaatcctagcactttgggaggccgaggccagcagatcatctgaggtcaggagttcaagaccagcctggtcaacatggtgaaaccctgtctctactaaaaatacaaaaattagtccctctccctctccctctccctctccctctccccggtctccctctgatgccatcaaagttgtgaaagctgaggctcgactgtactgccaccatctcggctcactgcaacctccctgcctgattctcctgcctcagcttgcagagtgcctgggattgcaggcgcgcgccgccacacctgactggtttttgcattttttggtggagacggggtttcgccatgttggccgggctggtctccagctcctgaccacgagtgatctgcctgcctcagcctcctgaggtgccaggattgcagatggagtctcgctcactcagtgctcaatgttgcccaggctggagtgcagtagcgtgatctcggctcgctacaacctccacctcccagccgcctgccttggcctcccaaagtgccaagattgcagcctctgcccggccgccaccccgtctgggaagtgaggagcatctctgcctggccacccatcgtctgggatgtgaggagcccctctgcccggctgtccagtctgggaagtgaggagcgcctcttcccggccgccatcccgtctaggaagtgaggagcgtctctgcccggccgcccatcgtctgagatgtggggagcgcctctgccccaccacctcgtctgggatgtgaggagcacctctgcccggccttgaccccatctgggaactaaggagtgtctctgcccgaccgccaccccgtctgggaggtgaggagcgtctctgcccggccgccccgtctgagaagtgaggagcccctccgcctcacagccgccccatctgggaagtgaggagcccctccgcctcacagccgccccatctgggaagtgaggagcccctccgcccggccagccgcccaatccgggagggaggtggggggcgcctccgcctggccactgccccatctgggaggtggggggcgcctctgcccggccaccccgtctgggaagtgaggagcccctctgcccagctgccactccatctgggaggtgtacccaacagctcattgagaacgggccatgatgacaatggcagttttgtcaaatagaaaagggggaaatgtggggaaaagaaagagagatcagattgttactgtgtctgtgtagaaagaagtggacataggagactccattttgttctgtactaagaaaaattcttctgccttgggaaaaaaaaaaaattagccaggtgtggtggcacatgcctgtaatcctagctacttgggaggctgaggcaagagaattgcttgaatctgggaggcggaggttgcagtgagccaagagggcgccactgcactccagcctgggcgatagggcaagactctgtctcaaaaaaaaaaaaaaattaaaataaagaaacaaaaaaacaaaacaaaacaaaaaaacagatggaaaaagatatcacacaaatgaaaaaaaaaagaaagcaggaaaaaccattctcataccatgtaaaagagactttaaaacaagaacactaaaaaataaaagacaaagagaggcattagataatactaaaggtttcagcatggcaaggagattggacaattttaaatatatattcatccaatactggagcacccagattcccaaagcaaatactaatagtcctaagaaaacagatttataggaataaaataatagtgggggacatcaacacctcactaacatcactacacaaatcatcaaggtagaaaatcaacaaagaaggccaggtgtggtggctcatgcccgtaatttcagcactttggcaggccgaggtgggtgcatcacctgaggtctggagttcgagaccagcctgaccaatatgatgaaaccccgtcactactaaaaatacaaaaattagccggccatagtggcatgtgcctgtaatcccagctacacgggaggctgaggcaggagaatcgcttgaacccaggaggcagaggttgcagtgagccgagatcgcgccattgcactccagcctgggcaacaagagcaaaactccgtctcaaaaaataagaaaaaaaaaaaaagaaaagaaaatcaacaaagaaactctgtacataaactatagacccaatggacctaatagacatttacagagcatttcagccaatgacttcagaatatacattcttctcatttgtgcatgtaacattgtctaagattgaccacatgcctcattacaaagcaagtctcaacaaattcaaataaatcagacttatatcaagcgtcttctcagaccacagtggaataaaattaaaaaccaataccaagaggaatgttcaaaattatgcaagtacatggaaactaaacaacttttttagagtgactcctggataaacaataaaaacaaacaagaaataaaaagaagttctttataatgaatgaaaaaatagagatacaacataccaaaatttctgcaatgtagcaaaagcagtaataggaggaaagcttatagtattaagcacgtacatctcatgttctttgcagggagatgaatggagctagaggccattatccttagcaaactaacacaggaacagaaaacaaaattccgcatgttctcacttataagtgggagctaaatgatcagaacacataaacacatagaggggagcaacacacactggggcctatcagagggcgaagggtgggaggagggaaaagttcaggaaaaataactaatgggtactagtttaatacctgggtgatgaaataatctgtacaacaaacccccataacacaagttcacctatgtaacaaatctgcacatgtacccctgaacttaaaagtaaaacaaaaacaaaaacataaaacaattagaaagagcttatagtaacaatgtagtattacacctcaaggaacaagaaaaacaagaaccaatcaaaatcaaagctggcagaaaataaatgagaaagatcagagcaaaactaaatgagattgaagccaaaaaagaatgatacacagaatcaatgaaatgaaaggttgattccttgaaagaattttaaaaattgagagaccattagctaggctaatcatggaaaaaggagagaagattcaaattatcaaatttagaaatgataaaggtgacattataactggtagcacaaaaatacaaaagatcatcagaaactactatgaacacccctatgcatacaaactagataacctagaggaaatggataaattcctggaaacatacagagtcccacgattgaaccaggaagaaatagaaatcctgaacagaccaataacaagtaatgaaattgaaatagtaataaaaaaaaaaatcttccaaaaacaacaacaaaagcccaaggctagatggattcacagctgaattttaccagacatacaaagaacacctcgtaccaatcttaatgaaattatatcaacaacttgagaagagatccctccctaattcattctatgaatccagggtcaccctgacactaaagccaggcaaggccacagtaaaaaaaaacaaacctacaggccaggtgcagtggttcacgcctctaatcccagcactttgggaggccaaggcgggcggatcacgaggtcaggagatcgagaccacggtgaaacctcgtctctaataaaaatacaaaaaattagccgggcgcggtagcaggcgcctgtagtcacagctactcgggaggctgaggcaggagaatggcttgaagccaggaggcggagcttgcagtgaaccgagatcacggcactgccctccagcctgggcgacagagcgagactccgtttcaaaaaaaaaaaaaaaagaaacctacaggccaatacgcatgataaacatagatgcaaaaatcctcaacaaaattcaagcaaaccaaatccaacagcacatcaaaaagataattcatcatgatcccgtggatttgtttcagggatgccagcactgttcaacatatgcaaatcactaaatatgattcaccacataatcagaactgagaacaaacaccatatatgatcatctcaatagatgtaaaagaggatttgataaaatccaatatcccttcatgataaaagtccacaacaaactaagcattgaaggaacatacttcaaaataataagagccatatatgataaacccacagacaatattatgttcaatggggaaaacttgaaagcaattcccccaagatctgaaacaagatgaagatctacactatcaccacactttttcaacatggttctgtaggtcctagccagagaaatcaggaaagaggaagaaataaatggcattcaaattggaaaagaggaagtcaaagtatctctttgttgatgacattattttatacctataaattgactcctctaaaagacttctagacttgatgaactacttcaataaatttgcagaatacaaaagtaataggccgggtgcagtggctcacgcctgtaatcccaacaccttcggaggccaaggcaggcagaccatgaggtcaagagttcgagaccaacatagtgaaaccccgtctctgctaagaagacaaaaagtaactgggcatggtggagcatgcctgtaatcccagctactcaggaggctgaagcagcagaattgatggaacccaggaggcagaggttgcagtgagccgcgatggggccactgtactccagccttggtgacagagcaagactgtctgaaaaaaaataaataaataaaaaacaaaaagaaaccaccttaggctgggtgtggtggctcatgcctgtaatcgctgcactttgagaggccaagacaggtggatcacttgaggtcaggagttcaagaccagcctggccaacatgatgaaaccccgcctctactaaaaatacaaaaattagccgagggtagtggcagacacctgtagtcccagctacttgggaagctgaggcaggagaatcacttgaatcctggaggcggaggttgtagtgagctgagatcataccactgcattccagcctgggtgacagagcaagactccatctaaaaaaaaaaaaaaaagttatgtacaaaaatttgtaacatttctatacaccaataatcttcaagctgagaatgaaatcaagaaatcaatcccatttacaatagccacaaaaaataaaatactgaggaatacatttaactaaaaaggtgaaggctctctaaaaagataactacaaaatcctaattaagaaattgtaggccaggcacggtggctcacgcctgtaatcccagtactttgggagaccgaggcggcggatcacaaggtcaggggatcgaaatcatcctggtttcacctaacatggtgaaaccccatctctactaaaaataaaaaaataaaaaaattagccgggcgtggtggcaggtgcctgcagtcccagctactctggaggctgaggaaggagaatgtcgtgaacctgggaggcagagcttgcagtgagcggagatcgagccactgcacaccagcctgggtgacagtgcgagactccatctcactggaaaggaacaaccggtaccagccgctgcaaaatcataccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgggcagagacacacataggctcaaaataaaaggatggaggaagatctaccaagcaaatggaaaacaaaaaaaaggcaggggttgcaatcctagtctcggataaaacagactttaaaccaccaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacataaattataacaaactatctctcagaccacagtgcaatcaaactagaactcaggattaagaatctcactcaaagctgctcaactacatggaaactgaacaacctgctcctgaatgactactgggtacataacgaaatgaaggcagaaataaaggtgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatacagacacaaaaaacccttcaaaaaatcaatgaatccaggagctggttttttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactatttcaatcaatagaaaaagagggaatcctccctaactcattttatgaggccagcatcattctgataccaaagctgggcagagacacaaccaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaacacagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaccccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacaacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtcaactcccattcacaattgcttcaaagagaataaaatacctaggaatccaacttacaagggatgtgaaggacctcttcaaggagaactacaaaccactgctcaaggaaataaaagaggatacaaacaaatggaaaaacattccatgctcagggggaaggaagaatcaatatcgtgaaaatggccatactgcccaaggtaaattacagattcaatgccatccccatcaagctaccaatgactttcttcacagaattggaaaaaactactttaaagttcatatggaaccaaaaaagagctcacattgccaagtcaattctaaaccaaaagaacaaagctggaggcatcacactacctgacttcaaactatactacaaggctacagtaaccaaaacagcatggtactggtaccaaaacagagatatagatcaatggaacagaacagagccctcagaaataacgcagcatatctacagctatctgatctttgacaaacctgagaaaaacaagcaatggggaaaggattccctatttaataaatggtgctgggaaaactggctagccatatgtagaaagctgaaactggatcccttccttacaccttatacaaaaatgaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggacctagttaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacgcttttacactgttggtgggactgtaaactagctcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaattatagactggattaagaaaatgtggcacatatacaccatggaatactatgcagccataaaaaatgatgagttcgtgtcctttgtagggacatggatgaaattggaaatcatcattctcagtaaactatcacaagaacaaaaaaccacacaccgcatattctcactcataggtgggaattgaacaatgagatcacatggacacaggaaggggaatatcacactctggggactgtggtggggtgggggaaggggggagggatagcattgggagatatacctaatgctagatgacgagttagtgggtgcagcacaccagcatggcacatgtatgcatatgtaactaacctgcacaatgtgcacatgtaccctaaaacttaaagtataataaaaaaattaaaaataaaaaaaaaaagaaattgtaggctgggtgcagtggctcacacctgtaatcccaacactttgggagttcgagctggtggatcacctgaggtcaggagtttgagaccagcctggccaacgtggtgaaaccctgtctctactaaaaatacaaaaattagccaggcatgctggtaggcacttgtaatcccagctactcgaaaggctgaggcaggagaatctcttgaacccaggaggcagaggttgcagtgagcgaagatcgtgccactgcactccagcctggtcaacagagtgagactctgtcttaaaaaaaaaaaaaaagaaggaaattgtagatgagaaacaaatggataaatattccatgtattggaagaattaatatgattaaaatgaccatatcttccaaagcaatctacagattcaatgctatcaccatcaaattactaatttcatttttttcactgaattataaaaaacaatcctaaagttcatatggaaccagaaaagaggccaaatagccaaagcaattataagcaaaatgaacaaatccagaagcattacatggcctgacttcaaattatactacaaaactatggaaactaaaacagcatggtactgttaccaaaatagatacattgatcaaaggaacagaggagagtaaatggaaataaagccacataccttcaaccaactaatatttgacaaaactgtcaaacataagcaatgtggaaataacaccccattcagggtgaatatgcaaagaaaagggaatgcttatacactgctagtgggaatgtagatttattcaactgctatgaaaaacagaataaatatatctcaaggaactaaaaacagagctaccattaaacccagcatccttattactgtatatctacccaaaataaatcattatataacaaacacactgagggatggctggcaagatggctgaaaagaaacagctccagtctgcagctcccagcaagatcaatgcagaagacaggtgatttctgcatttccaactgaggtacctggctcatctcgttgggactggttagagagtgggttcagcccatggagtatgagccgaagcaggatggggcattgcctcacctgggaagtgcaaggggttgaggaactccctctcctagccaagaaaagccttcagggactgtgctgtgaggaacattgcattctggcccagatactatgcttttcccacggtcttcacaacccagagaccaggagattccctccggtgcctatgccaccagggtcctgggtttcaagcacaaaactgggtggccgtttcagaagacaccgagctagcttcaggaggtttttttcataccccagtggcatctggaatgccagcgagacagaaccgttcacacccctggaaagggggctgaagccagggagccaagttgtctagctcagcggatcccacccccacagagcccagcaagctaagatccactggcttgaaattatcgctatcagcacagcagtctgaagtcaccgtgaaatgctcaagcttggtagggggaggggcatccgccattactgaggcttgagtaggcggttttcccctcacggtgtaaacaaagccaccaggaagttcaaactgggcggagcccaccacagctcagcaaagccactatagccagactgcctctctagatgcctcctctctgggcagggcatctctgaaagaaagacagcagcctcagtcagcggcttatagataaaactcccatctccctgggacagagcacctgtgggaaggagcagctgtggcagcagcttcagcagacttaaacgttcctgcctgccagctctgaagagagcagaaaacctcccagcacagcgctcgagctctgctaaaagacagacggcctgcccccataactcctgactgggagacacctaccagcaagggttgacaaatgcctcatacaggagagctccagctggcatctagcaggtgcccctctgggacgaagcttccagaggaagaaacagtaagcaatctttgctgtactgcagcctctgctggtgatatccaggcaaacaggctctggagtggacctaaggcaacctacagcagacctgcagcagaggggcctgagtgttagaaggaaaactaacaaacagaaaggaatagcatcaacatcaacaaaaaggatgtccacacagaaaccccatctgaaggtcaccaacatcaaaggccaaaggtggataaatccacaacgatgaggaaaaaccagtgcaaaaaggctgaaaattccaaaaactagaatgcctcttctccaaaggatcacagctcctcgccagcaagggaataaaactggatggagaatgaatttgacgaattgacagaagtagactttagaaggtgggtaataacaaactcctccaagctaaaggagcatgttctaacccaatgcgaggaagctaagaaccttgaaaaaaggttagaggaattgctaactagaataaccagtttagagaagaacataaatgacctgatggaggtgaaaaacacagcatgagaatttcgtgagcatacacaaatatcaatcgccgaattgatcaagtggaagaaaggataccagagattgaagatcaacttaatgaaataaagtgagaagacaagattagagaaaaaaaaaatgaaaaggaaccaagaaagcctccaagaaatatgggactatgtgaaaagaccaaacctacgtttgattggtgtacctgaaagtgatggggagaatggaaccaagttggaaaacactcttcaggagaacttccccaacctagcaagacaggccaacattcaaattcaggaaatacagagaaaaccacaaagatactcctcgagaagagcaaccccaagacacatagttgtcagatgtgtctgacatttcaaccacggttgaaatgaaggaaaaaatgttaagggcagccagtgagaaaggtcaggttatccacgaagggaagcccatcagactaacagtggatctctctgcagaaaccctacaagccagaagagagtggaagccaatattcaacattcttaaagaaaagaattttcaacccagaatttcatatccagccaaactaagcttcataagcaaaggagaaataaaatccttgacagataagcaaatgctgagggattttgtcaccaccagacctgccttacaagagctcctgaaagaagcactaaacatggaaagaacaactggtaccagccactgcaagaacataccaaactgtaaagaccattgacactatgaagaaactgcatcaacaaacagccaaaataaccagctagcatcttaatgactgccaaaattcacatataacaatattaaccttaaatgtaaatgggctaaatgccccaatttaaaaaaacagactggcaaattggatagagtcaagaaccatcattgtgctgtattcaggagatctatctcatgagcaaagacacacataggctcaaaataaaggggtggaggagtatttatcaagcaaatggaaagcaaaaaaaaaaaaaaaagcaggggttgcaatcctagtctctgataaaacagatattaaaccgaaaaagatcaaaaatgacaaagaagggcattacataatggtaaatggaacaatggaacgagaagagctaacaattgtaaatatatatgcacccaatacaggagcacccagattcataaagcaagttcttagagacctaaaaggagacttagactcccacacaataatagtgggaaactaacacccctttgtcaatattagactgatcaacgagacagaaaattaacaaggatattcagtacttgaactcagctctggaccaagtggacctaatagacatctacagaactctccaccccaaatcaacagagcatacactcttctcagcaccacattgcacttattctaaaattgaccacataattggaagtaaaatactcctcagcaaatgcaaaagaagggaaatcataacagtctctcagagcacagtgcaatcaaattagaacttaggattaggaaactcactcaaaaccacacaactacatggaaactggacaacctgctcctgaatgactacaggataaataacgaaattaaggcagaaataaataagtccaatgagaacaaagacactatgtgccaggatctctgggacacagctaaagcagtgtttagagggaaatctgtagcactaaatgcccacaggagaaagcaggaaagatctaaacaccctaacatcacaatgtaaagaactagagaagcaagagcaaccgaatttgaaagctagcagaagacaagaaataactaagatcagagcagaactgaaggagattgagacacaaaaaaacccttcaagatattaatgaattgccaggcgtggtggcttatgcctgtaatcccagcactttgggagtccaaggcgggcagttcacaaggtctggagttcgagaccagcctgaccaacatggtgaaaccttgtctctactaaaattacaaaaattaactgggcgtggtggcacgtgcctgtagtcccagctactcgggaggctaaggcagaagaactgcttgaacccaggaagcagaggttgcagcgagctgagattgtgccacttcactccaccctgggtgacagagtgagaccttgtctcaaaaaaaaaaaaaaatcaatgattccaggagctggttatttgaaaagattaacaaaatagatagactgctaggcaaactaataaagaagaaaagaaagaagaatcaaatagacacaataaaaaatgataaaggggatatcatcactgatcccacagaaataccaactaacattagcgaatactataaacacctctatacaaataaactagaaactctaaaagaaataaattcctggacacatactctcccaaaactaaaccaggaaaaagttgaattcctgaatagaccaataacaagttctgaaattgaggcagtaattagtagcctaccactcataaaaagcctaggaccagatggattcccagccaaattctaccagaggtacaaaaaggggctggtaccattccttctaaaactattccaaacaatagaaaaagaggggcttctccctaactcattttatgaggccagcatcatcctgataccaaagcctggcagagacacaacaaaaaaagaaaatttctggccaatatccctgatgaacaccgatgcgaaaatcctcaataaaatactggcaaatcaaatccagcagtacatcaaaaagcttatccaccatgatcaagtcagcttcatccctaggatggaaggatggttcaacatatgcaaatcaataaatgtaatccatcacataaacagaaccaatgacaaaaaccacatgattatctcaatagatgcagaaaaggccttagataaaattcaacacccctgcatgctaaaaactctcaataaactaggtattgatggaacgtatctcaaaataacaagagctatttatgacaaacccacaaccaatatcatactgaatgggaaaaagctggaagcattccctttgaaaactggcacaagataatgatgctctctcttaccactcctattcaacatagtattggaagttctggccagggcaatcaggcaaaagaaagcaataaacggtattcaaataggaagagagaaagtaaaattgtccctgtttgcagatgacatgattgtctatttagcaaaccccatcatctcagcgccaaatctcctaaagctgataagcaacttcagcaaagtctcaggatacaaatcaatgtgcaaaaatcacaaccattcctatacaccaataatagacaaacagagacccaatcatgaccaaacttccattcagaattactacaaagagaataaaatacctaggaatgcaacttacaaaggatgtgaaagacctcttcaaggagaactttacaatactatctccatcaagctaccattgacattcttcacagaattaaaaaaaacttctttaaatttcatatgaaaccaaaaaagagcccatatagccaagacaatcctaaacaaaaagaacaaagctggaggcatcacactacctgacttcaaactatactacaagtctacagtaaccaaaacagcatggtactggtaccaaaacaaatatatagaccaatggaacagaacagaggcctcagaaataatgccacacatctacaaccatctggtctttgacaaacctgacaaaaacaagcaatggggaaaggattccctatttaataaatggtgttgggaaaactgcctagcaatatgcagaaaactgaaactggaccctttctttacaccttatacaaaaattaactcaagatggattaaaaacttaaacttaagtcctaaaaccataaaaaccctagaagaaaacctaagcaataccgttcaggacataggcatggggaaagtattcatgactgaaacaccaaaagcaatggcaacaaaaggcaaaatggacaaatgggatctaattaaacctaagagtttctgcacagcaaaagaaactattatcagaatgaacaggcaacctataaaatgggagaaaatttttgcaatctatccatctgaaaaaggactaatatctagaatctacaaggaacttaaacaaatttacaagaaaaaaacaaacaaccccatcaaaaagtgagcaaagtatacgaacaaacacttttcaagagaagacatttatgcaaccaacaaacatatgaaaaaaagctcatcatcactggtcattagagaaatgcaaatcaaaaccacaatgagataccatctcacgccagttagaatagtgatcattaaaaactcaggaaacaacagatgctggagaggatatggagaaataggaacacttttacactgttggtgggagtgtaaattagttcaaccattgtggaagacagtgtggtaattcctctaggatccataaccagaaataccatttgacccagcaatcccattactgggtatatacccaaaggattataaatcattctactataaagacacatgcacacgtatatttattccagcactgttcacaatagcaaagacttggaatcaacccaaatgcccatcaatgatagactggataaagaaaatgtggcacatatatgccatggaatactacgcagccttcaaaaagatgagttcatgtcctttgcagggacatggatgaagctggaaaccatcattctcagaaaactaacacaggaacagaaaaccaaacactgcatgttctcactcataagtgggagttgaacaatgagaacacatggacacagcgagaggaatatcacacaccaggtcctgtcagggggtgggcagctaggggagagatagcattaggaaaaatacctaatgtagatgatgtgttgatgggtgtagcaaaccaccatggtacatgtatacctatgtaacaaacctgcatgttctgcacatgtatctcagaacttaaagtttaataaactacagtaataataaaacagaatcagtccgggcacagtggctcacagctgtaatcccagcactttgggaggccgaagcaggcggatcacctgaggtcaggagttcgagaccagcctggccaacatgatgaaaccctgtctctactaaaaatactaaaattagttggacatggtggcgcacctgtaatcctggctatcctgtaggctgaggtgagaggattgcttgaacctggaggcggaggttgcattgagccgagatcttgacattgcactccagcctgggcaaaagagtgagactccatcttgattaaaacatactccttgtattatatacttatattaaagtattcttttgtaagtaaaaaaaaaaaaaacatagtaataagaaaatagaatgatgccgggcacggtggctcacgcctgtaattccagcacttttggaggccgaggcaggcagagtacgagatcaggaattcgagaccagcctggccaacatagtgaaacccggtctctgctaacaaaatacaaaaattagtcaggtgtggtagcacgtgcctgcagtcccagctgctcaggaggctgaggagggagaattgcttgaacctgggaggcagaggttgcagtgagccaagaccacaccattgtactccaacctgggtgacagagtgagacccagatagagatattatcacaaatacagcaaaatgttagtgtaaaatctaggagctgagtttatggatattcactatagagtttttattgaattttctatatgtttgcccattttcataataaatgttggaggaaaatagaaaacacacacacacacacacacacacacctgctgggcatggtggctcacgcctgtaatcccagcactttgggagcccaaggtgggcgaatcacctgagatcaggagttcgaccagcctgaccaacatggagaaaccccatctctactaaaaatacaaaaaaaaaaaattagcaaggcgtggtggcacattattgtaatcccagctactcaagaggctgaggcaagagaatcacttgaacctgggaggcggaggttgcagtaagctgagatcacaacattgcactcctaggcaacaagagcgaaaactccatcaaaaaaaattttttaatttaaaaaacccaaaacacctacactgacatgtgtatcacagaactattcacaatagcaaagtcatagaaccaacctaagtgtccatcagtggttgactagataaagaaaatgtggtacatatatgccatggaatattatgcagccataaaaacaataaattcatgtcttttgcagcaacctggttatacctggaggtcattatcctaagtaaactaactctgaagcagaaaatcaaatatcacatgtactcagttataagcaggaactaaacgatgaatacacatggacataaagatggaaataatagacactgggggctcaaaaaaaaggggagagtgggagggataaagattgaaaggttacctgttggatacaatgttcaatatttgggtaatgagtacactagaagcccaatccccacaattatgcaatatacccatgtaacaaatatgatgggtacttgctgaatctaaaatttttaaaaagatgaaaatcaaaaagtttattgaaacgaatgaaaatggaaacacaggccaggcatggtggctcacgtttgtaatcccagcacttcgggaggccgaggcgggtggatcactaggtcaggagttcaagaccagcctggccaagatggtgaaatctcatctctactaaaaatacaaaaattaactgggtgtggtggtgggcgcctgtaatcccagctactcgggaggctgaggcacaagaactgcttgaaccccagaggcagaggttacagtgagccgagatggagccactgcactccagcttgggcgacagagtgaggctcagtctcaacaaaaaaaaaaagaaaaaagaaaaaagaaaaagacataaatagacatttctcaaaagaagacacacaatcaatgggtatatgataaaatgtttggccaggcgtggtggctcacgcctgtaatcccaccactttgggaggccaagggggcgcggatcaccaggtcaggagttcgagagcagcctgaccaacatagcgaaaccccaactctactaaaaatacaaaaattagctggatgtggtggcgtgcacctgtaatcccagctactcaggaggctgaggcaggagaatcgcttgaacccgggaagcagaggttgcagtgagcctagactgtgccactgcgctccagcctgggctacagagggagactctgagactccatctcaagaaaaaaaaagtttaacatcactaattatcggagaaatacaaatcaaaaccacaatgtgatattatcttatcttattcagaatggctattatgaaaaggacaaaaaatttaaaaatgttgattaatatgtggagaaaagaaacacttatacagtgttattgggaatgtaaactagtacagccactgtgaaaaacagcatggggatttctcaaaaaataaaattttcatttgatccagcaatcccactactgggtatttaaccaaagggaaagaaatcactacatcaaagagatacctgcactcacatgtttattgcagcacattatcacaatattatttctttcaaaccaggagcatggaacgtctttttatttgtgtatgtgtgtgtgtgtgtgtgtgtgtgtgtgtgtactcttcaatttctttcatcagggttttgtagtttttattgtaaagttctttcacctccttggttgaatttattcctagctatttaattttttagagctactgtaatggtattgctttcttgatttgcttttcggctagtttgctattgattattattgatatatggaaacactagtgatttttttttttttgagacagagtttcactctcattggccaggctagagtgcaatggtgcgatctcggctcactgcaacctccacctcctgggttcaagcgattctcctgcttcagcctccaagtagctaggattacaggtgcccaccagcacacccagctatttttttgtatcttttagtagagacaagtttcaccatgtttgtcaggctggtctcaaactcctgacctcaggtgatacacccatctcggcctcccaaagtgctgggattacaggcgagagccactgcgccttgccaacactagtgatttttgtatgttaattttgtatcgtgttcctttactaaatttttaaaatcacttctaagacatttttggtggagtctttcagttattctagatataagatcatgtaatcttcaaagagaaacaattctcattgccaatttggatgccctttatttctttctcttacctagtggctctggctaggatttcaagcagtatattgaataaaagtggtgaaagtggacatccttttcttcttccagttctcagaggaatgactttcatcttttcccctttcagtgtggtgttagctgtgggtttgtcatatacaatcattattttgaggaatgttctttctttttctttctttttttttttttttttttttttttgagatggagtttcgctcttgttgtccaggctggagtgcaatggtgtgatctcggctcactgcaacctctgcctcctgggttcaagcgattgtcctgcctcagcctcccgagtagctgggattacaggcatgtgccaccacacacggctaattttgtatttttagtagaaacagttttctccatgctgatcaggctgggctcaaactcctgacctcagttaatccgcctgcctcggcctcccaaagtgctgggattactggcgcgagccacctcgcccggctgaggaatgttctttgtatacctagtttatgaagagtttttatcatgaaggaatgttgaattttattaaatgctttttctgcatctattgagaaaatcatttagtttctgtcctttattctgttgatgtgatgtaccacatttattgatttgcttacgttgtaccacacaagattataaattttgttatgtgtatttatcataataaaaacatttttttttgagacagtcttactctgtctcccaggctggagtgcagtggtgggatctcggctcactgcaacctccgtctccatctcctgagttcaagtggttctcctgcctcagcctcccaagtagctgggattacaggcatgctctaccacacctgactaatttttgtatttttaatagagagagggtttcaccatgttggccaggctggtatcgagctcctgacctcaggtgatctgcctgcctcggcctcccaaagtgctgagattacaggtgtgagccactacacccagcctaaagacaatttttaaaccccactatacataggagaaagaactttacaatgaaaactacaaaagcttgaatgaaagaaattgaagaggacacacacacacacacacacacacacacacacacacacaaataaataaataaacacccacactcagggtttgaaagaaatttatatatctataaatatatatatataacatgtataatatgtattctgcatcagaatagcatacatcacaaaggtagtcagtatggaatttgacgctttttataagtttttgtccttattactggtgttcctgtctcccacctcctataactccagagtttgtctttttttttttttttgagatggagtctccctccgttgcccaggctggagtgcagtggtgcaatctcggctcaccacaacctccacctcctgggttcaagcgattcttctgcctcagcctcccgagcagctggaactacaggcgtgtgccaccatgcccaaataatttttgtatttttattagagacagggtttcagtatgttggccaggctggtctagaactcctgacctcgtgatccacctgcctcagcctcccaaagtgctaggattacaggcatgagccactgtgcccagccagagtttgtatttcattccagttacatatagtgaatttaaataaacacatctctaggattggactcctgatcataggatactccaggaccctgaaagctaggtcaggtctagacctaacagatgttaaagtatgcctccagctgataggcaaaatgattccccatggctacttgagatgctcaaagttcaaaaagaaccaggcagttatggctttgtgtgggagcagtcatgcactctgttctcagaaagatgtaaaagtatcacaagacctccctttctgtaatcaagccaatccagttccttttttggtgccaagataaactatggccaaagctcctcccccaaccagtaatttgaaaaaaacatttgacagagacttctggttttggtcttggaaaccgtatcagttcatttatgtgttgctgtaaagaaatacctgaagctggccagacgcagtggctcacgcctgtaatcccagcactttggaagacagaggcgggcggatcacgaggtcaggaggttgagaccaccctggctaatgcggtgaaaccccgtctctactaaaaatacaaaaaattagccgggtgtggtggcgggcgcctgtagtcccagttactcaggaggctgaggcaggagaatggcgtgaacccaggaggcggagcttgcagtgagcagagatggtgccactgcactccagcctgggcgacagagcgagactccatctcaaaaaaaaaaaaagaaatacctgaagctgggtaatttataaagaaaagaggtttgtttagctgtcagttctgcaggctgtacataaagcatagtgtcatcatttgctcctgctgagggcctcaggaagcttacaatcatggcaaatagtgaaagggagccagcatcaaatggcgagagagggagaggatggtgtcaggcccctttaaacaaccagctttcacatgaattcagagtgagaactcattcattaccatgaggaaaacaccaagccataaatgaggactccacccccatgaccccagacatcttccactaggcccacctccaacattggaggtgatatggtttggctctgtgtcaccatgcaaatctcaccttgagttgtaataatccccacgtgtcctgggagagacacaatgggaggtaattaaatcatgggggcaggtttttcccatgttgttctcatgatagtgaataagtctcacaagatctgatggttttataaaggggagttcccctgcacatgctctcttgtctgccaccatgtaagatgcgacttttctcctcatttgccttctgccatgattgtgaagcctccccagctatgtggaactatgagtcaattatacctctttcctttataaattacccgatctcaggtatgtctttattagcagcatgaaaatggactaatacagtaaattggtaccagtagagtggggtgctgctataaagattcctgaaaatgtggaagagactttggaactgggtaacaagcagaggtcggaacagtttggagggctcagaggaagacaggaaaatgtgggaaagtttgcaacttcctagagacttggagggctcagtaaacagaaagaagcgggaaagtttggaacttcctagagacttgttgaatggctttaaccaaaatagtgacagtgatatagacaataaagtccaggctgagttggtctcagaaggagatgaggaattcgtttggaactggagtaaaggccactcttgctgtgcaaaaagactagcagtattttgcccttgccctacagatctgtggaacttttaacttgagagagatgatttagattatctggcaggagaaatgtataagcagcaaagcattcaagaagaagcagcacataaaagtttggaaaatttgcagcctgacaatgcaatagaaaagaaaaacccattttctggggagaaattcaagcctgctgcagaaatatgcataaataacaaggagccgaatgctaatcatgaagacaatggggaaaatgtctccagagtatgccagatacctttgcagtagcccctcctatcacaggctcagaggcctaggagaaaaaaatggtttcatgggctggactcaggggccccctgctgtgtgcagtctagagacttgttgccccatgtcccagctgctccagccatggctaaagggggccaaggtacagcttgggctgtggctttggaggctgcaagccccaggccttggcagcttccatgtggtgttgagcctgtgggtgcacagaagtcaagaattgaggtttggaaacctctgcctagatttcagaggatgtgtggaaatgcctggatgtccaggcagaagtttgctgcaagggtggggacctcatggagaacctctgctagggcagagcagaaggaaaatgtgtgattggagcccctatacagagtctccactggggaactgcctagtggagctgtgagaagagggccatcgtcctccagacctcaaaatggtagatccaccaacagcttgcactatgcatctggaaaagccacagacactcaacagcaacctgtgaaagcagtcaggagtggggctgtaccctgcaaagccacaggaactgagctgcccaagaccatgggaacccacctcttacatcagcatgacctagatatgagacatgtagccacaatagatcatttgggagttttaagatttgactgccccattggatttcagacttgcatgaggcctgcagccccttcattctggccaatttctcccatttggaatgggtgtatttatccaatgcctgtacctcccattgtatctaggaagtaactaatttgcttttgattttataggctcacaggtggaagggacttgccttgtctcagatgagactttggatttcggacttttgagttaatgctgaaatgagttaagataggaattccactaaacctataaatcaatttggggataattgacatctttactatgttgaattttctaattcatgaatattgttaatgtttctaattatttagctcttttaaaatttctttcatcagcattgtttaattttcagcatataggtccagtacatgttaagtttatacgtgagtgtgatttcattttccttggaatggttgtaaatgttgtgtttttaatttcagtatttacatattcattgtcagtatgtagaaattcagttgatatttgtatgttgattttgtagtctgtgacattgctgaactcattaattctatgaaattttttggagattctttggaattttctacatagaaaagcatgttggctggcagcagtgactcacccctctaatcctaacttccagctgcatccatattgctgcaaaggacatggttttattcttttatatggctgcatagtattccatggtgtatatgtgcattttctttatccaatctaccattgatgggcacctaggttgatcccatgtctttgctattgtgaatagtgctgagataaacatatgagtgcaggtgtctttttggtagatgatttgtttcctttgggtatatactcattaatggattgctggctcgaatggtagtcctatttttttctacttggagaaatctccaaaatactttccacagtggctaaactaatttacatccccaccaacagtgtataagcactccctttctctacaacctttttactttttaataattaatagccattctgatttgtgtgagctggtatttcattgtcattttgatttgtatctctctgatgattagtgatgttgaactttgttgttttttcttttttagaccgagtcttgccctgtcaccaggctggagtgcagtggtgcgatcttggctcactgcaacctttgcctcctgggttcaagtgattctcctgcctcagtctcccgagtagcagagactacaggcatgagccactacaccctgttaatttttgtatttttagtagtgatggggtttcaccatgtcggccaggatggactggatctcttgacctcgtgattcgcccaccttggcctcccaaagttctgggattacaggcatgagccaccgcgcctggcctgaactttttttaatatgtttgctggccacttgaatgtattcttttgagaagggtctgttcatgttttttgcccacattttaatggggttgtcttttacttgttgatttaagtttcttatagatcctggatattagtcctttgccagaatcatagtttgtaaatattttatcccattttttctgtttactctgttggtaatttattttgctgtgcagaagctctttagtttaattaggtcccacttgttcaatttttggttttattgcatttgtttttaagaacctagtgataattttttttttttttttgcctagaccaatatcaaagagagtatttcctaggttttcttccaggatttttataattttagatcttatattgaagtatttaatctatcttgagctaattttcatacatgctgatagataggggtccagtttcaatcttctgcatatggctacccagtttttccaacaccatttattgaatagggtgtcctttccccattgtttatacatgttgagtttgtcaaagatcagttggttgtagctatgtgactttatttccgggttctctattatgttctattggtccatgtgtctattttcgtaccagtaccatttgtttttggttacttgtagtattgtttgaagttgggtagtgtgatccctccagctttattctttttattttatttatttattttttttgtgtgagacggagtctcactctgtcgcccaggctgaagggcagtggcacgatctcggctcactgcaagctccgcctccctccggctttattctttttcatagaattggcttggctattccagctcttttttggttccatatgaattttagaataggtttttcctgattctgtaaaaacgacattggctatttgataggaatagtgttgaatctctatattgccttgggcaatatggacatttcaatgatactaattcctccaacccatgagcatggaatacttttccaattgtctgtgctgtctgtgattattttcagcagtgttttgtagttcttctcatggagatctttcactgccttcgttaggtgtattcctatgtattgttgtatatgtgtgtgtgcctattgtaaatgggattgcattcttgatttgtttctgagcttaaacattattggtatatagaaatgctatagatttttgtacattgattttgtatcctgagactttacagaagtcatttatcaggcctaggagtttttggggggaatatttaggattttctaggtatagaattatatcattagcaaagagataatttgaatttgacttcctctttttttatttagacaccttttatttcttttctttttttttttttttgctgagacagagtctggctgtctcccaggctagagtgcagtggcatgatctctgctcactgcaagctccacctcccgggtttatgccattctcctgtctcagtctcccgagtagctgggacaacaggcacctgccaccacacccagctaattttttgtatttttagtagaggcggggtttcactgtgttagctaggatggtctccatctcctgacctcttgatccacccgcctcggcctcccaaagtgctgggattacaggcgtgagccaccacgcctggctgacaccttttatttctttctcttgcctgattcctctggctaggacttatagtactatgttgaataggtgtggcaagagtgtgcatccttgtcttgttccagttcttagaggtaatgcttccaacttttgcctattcagcatgatgttggctgtgggtttgtcatagatggctcctattattttgagatacggtcttttaatgactggtttgttgagggtttttattattaaggaatgttgaattttatcaaatgctttttctgtgtctgttgaaaggatcatatggttttcgttttaaattttgtttatgtggtgaagcacatttgttaatttgcatatgctgaaccattcttgcatccaaggaataaagcccacttgatcatggtgaattaactttttgatttggtttggtagtgttttttgaggatttttgcatctgtgtttattggggatattggcctgtagttttcttcttttgttatgtctttgtcagattcacgtctatgcttttacatgcaatgtaatcccttccatttcaatcaaatgtaatcccttccatttcaatcaaaagaccaattcaagtcttacttcctccttttagcagtctctgataaccacatcatacgtgattgttcctttctctcaactcttctagcattttgactactaggatgcttacagtgctgtatctttgagagcagaggctatagcttattcttacatgaatatgtcattggctccagtcccagtgcttggcacagagcagacactctttaataaagaaatgaattttattcagcttttttcccatcttatttcttaccagaaatacaaattgtatgagtttcagaaaaatggtatttcggtcaaagtgacaggctcactaaaagacaataatgcatttcattgaaaagcaggatatattttttatttaatgactcttcctctgacatctacttgtgacagaaaatgttaaaatttagtacccaaacactaccctacacacatgcatgcatatacacacatttatgggaatttagctgttaccatgctagagaatgatattgggtgggttttttttgggtgggggggacttttctttgtttttgagacagggtcttactctttcactcagactggagtgcagtggcacaatcacggctcattgcagcctcaacctcctgggctcaagccatcttcccacttcagcctctcaagtagctgggactacaagtgcacgccaccctgcctagctaatttttgtaatttttgtagagatgggacttcaccatgttgctcaggctggtctcaaactcctgggctcaagcaatccacccaccttagcttcccaaagtgctgggattgtaggcatgagccactgtgcctggctagagatattaacatgctatctttttttctctctctctttttctcttttgagacagagtttcactgttgttgtccatgctggagtgcaatggcgtgatctcggctcaccgcaacctctgcctcccaggttcaagcaattctcttgccttagcctcccgagtagctgggattacaggcatgtgccaccacgcccagctaattttgtatttttagtagagacagggtttctccacattggtcaggctggtcttgaactcctgacctcaggtgatccgccctcctcagcctcccaaaatgctgggattacaggcgtgagccaccgtacttggccttaacatgctgtcttgcgcctagctttctttttcattttatcatgaatagcccatagagtcaacctgggtgatggaggaaagaggttaggcagagaaaaatagctaacaaacagaagcaagaaaacataacaggagttggggaaacagagacaatgtgaattcagaaccattagaccatgacatcgagttgtgtaccagttttggagaggaggccactgggaacatcttgaggaaaaaaagggaaaatcaaaccaaatctcagaagcaatgtcatatcttgaacttcacaaataaatgtataagatggagaggaggaaagaaaacacctaaagactaagccacaagtgaggtatttcctgacgtactgagcagtagggggacccaatcccaccttctctaagctaaaggccaatatggtcagatggggaggcatcaggtggtatgaagggatggattctttcagagggtttttgcttccataagaaataacaaaaaagaccacaaaactgcaaatttagaaataatcaagaaatttagtgacacaggaagaggaggtttctttttttttctttttttttttttttgagatggagtcttgctctgtggcctaagctggagtgcagtggcacaatctcagctcactgcagcctccacatcccaggttccagcgattcttctgcttcagcctcccaggcagctgggattacaggcacgcagcaccacgcccagctaatgtttttcttttgtattttttagtagagatggggtttcatcatgttggccaggctgatctcaaactcctgacctcaggtgatccgcccacctcagcctcccaaagtgctaggattaca

SEQ ID NO: 40 - DNA, 16 bp, Homo sapien
  misc_feature (3)..(4): n is a, c, g, or t
  misc_feature (6)..(7): n is a, c, g, or t
  misc_feature (10)..(10): n is a, c, g, or t
gcnncnnggnggcagg

SEQ ID NO: 41 - DNA, 34 bp, Artificial
  synthetic
ataacttcgtataatgtatgctatacgaagttat

SEQ ID NO: 42 - DNA, 34 bp, Artificial
  synthetic
tattgaagcatattacatacgatatgcttcaata

SEQ ID NO: 43 - DNA, 300 bp, Homo sapien
gtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttg

SEQ ID NO: 44 - DNA, 27 bp, Homo sapien
gtgatcagccagctacctggtggcagg

SEQ ID NO: 45 - DNA, 27 bp, Mus musculus
gtgaccagccagcaacctggtggcagg

SEQ ID NO: 46 - DNA, 247850 bp, Mus musculus
aagcttctgaagaaagaattgaggtatcagaagatggaatgatgcagatgctgtatgacccttgctaggtctgtgagtataaggatgacataggtaggtgaggttctgggtgaatcatcaagctgggccagtgcccacacggcatggaccaaggtaggtctaggagtgtggggaggcttggactagtgatgttcacaatagcaagctgaatgatctgagctaggttgaaaactgtggtgacagcatggccaggtgagattccagtggttcacaactgcctgtgacaccagttcaaggaggtccaatggccacttctgacctatttggacttctacacacatgtatatatacaccaaggcacacaaatatgcacataaataaatagaaatacaaagaggctagagagctgaatcaatggttaagaactctagctgctccttcagaggacctaggttccattcccagcatccacatgactgttcaaacgttttgtaactccagttctaggggaatcaacactctctttggcccactgaggataagagatatgcatgtagttcagagacatagacgcaggcaaaacattcgtacacataaaataaaagtagtacaataaatattttaaaagacacaagttagttgagtggattaagagacctcattttggttgttaagaaactcatcttaacttcaagaatagccaccattatagagtgaaaggattgggagcaaaatgcattctaagcaagtgggatcaggaaataggcagacattgctatcctaaaatctgacaaaatagacttcaaattaagactaataagaatggacaaagaaggaatcttcattctgatcaaaggaataattaagaaagaagaaattacaaatctaaacatacatgcaccaaactctggtgtacctaatttcatataaagcacactcctggacttagtaagacatatattaaccacaattaagtccacacttttcttcaataaagtcaattagataaaaaataaataactaaacaaaaaactgaagggacattgtaaacataatgaagctaacaggtatctacagaatacacgaccgaaacatcacgaaatatggattctactcagcagtttatgtttctattaaagagaacacatactgggatacaaaacaaatcccaacaaaaattgaaataactacatgtatcttatctgatcacaatgcagttgtcttagttactgttctattgttgtgaggaaataccatgaccaaaatgactcttatttataaagcatttaatagaagacttgcttacaattgtagaggattagtccatgatcttcacagcagggaaacaagcatagagctagagctggagctaaaagttttgcattctggtctgcaggcagcgggtagagagacactgaatttattgtgggcttttaacactccagagcagtgaaatgtgttagaaaataaaaactacacatcaatatccctgatgagaatagataaaaaattctcaataaaatactagcaaatacatatatatgaaaaagatcattcaccaagactaagttaactttattctggacatagaaggatggttcaatatacgaaagtcataaatataaattggcttaaaacaaaaatcatatatttcatttcaaatcattcatttcaatagatgcagaaaaagtctttgacattaccaacataccttaataatagaaatcctgggggagaattagataaaagctttatatgacaaatccacagccagcatcatcttaaatggagaaaattttaatgaaatcttactaaaatcaggactgagaaagactgtccactaatcctcattcttttccaataatttggtgcttaaatctttagctacaatgagaaaagagaagaaaattaagggggtacaaataggaaaagaaataaatttatccctatttgcagatgatataagcgtatgcataagagatcacaaaacttaaaccacaaatgatcaaccctttaaacaaagtggaaagatttttaaaaattaacttataaaaatcaatagacttcccaacaaatattctgagaaaagattatgaaaacagtcccattctcactagcagaaaaaaatatatccaggaataatcctaatcaaggaggtgaaagacctatccattgaaactttaaatctttgaagaaagagattgcgaagacactagaagatgaaaatacctcccatgctcatgtattgatagaattaatgctgtgaaaatgaccatcctacctaaatcaacttacaaatttagcaccatcccaataaaaaatcccataacattcttcacagaagtaaaaaaaaaatgtaaaaactcatacagaaatgcaaaggtctaagatagccaaagcaatcctgagcaaaaagagcaatgccagaggggctaccatattagagttcaaggtagattgcagagctatagtaatcaagacagtgtggtactggcacaaaaacagacttgtagatcaataaaactaaatcaaagactcaagcatgagtgtatataattgcaaatatctgatatttaacaaagatgtcaaaaaaatacacactagaggagtgacagcatcttcaacagatggtgctggaaaactgaatatccacaagtgcaagaacaaaattggatccatatttatcactctgcacaaaattcaactgcaaatttatcagatatctcagtgtgaaacccaaaacactaaatctgctaacacgaaacataggcagtaccctgcaaaagacaagagtgtgctcaggcaggaattaaagccaatatctgacaaatgagacctcgtaaagttaaaaggcttctgtacagcaaagaaaacagtaaaatccgctaaagaaaaagacaacaaagtaggaaaaaatcttagtcagttataccgctgatagaggattaataaccagaacagacgaagagctcagaaaacaaagaatcaagaaaacaaatgacctaattaaaatataggctaatctgaacagagagttctcaaaggaagaacaaaaagtggctaagaaataggtgaaaaagatgttcaacatccttagtaatcaggaaaagaccaattaaaactaatttgggatttcatgttacaacagccagctaagacttcgaaaacatctgacaccaaattctggcaagattcaaggaaaacaaggttggtgggagtgaaaattggtgccaccctccagacatcagcgtggataatcctcaaaaaggtagaagcagatctaccatatgacccagctctgccgttcctcgtcctacgacagagctgctctacttcctcagccatgttcaaggctgctctatgcccactaattaagaaatggaaacaacccaaatgtccttcagccgagaaatggataataaaaatgtgtcacacttgtacaatgggattatattcatctgcaaagaacaatgaaaacttctggtacattgatagaattggaagatagactgaagaaggaaactcagacccagatagacgagttctcttgtatctgtgaatcctgactctgagatcttaaatgtgagaatataacataaaataaacctcagaagctggggaagtaaaatatgacttcattggatgtagaccaacaaaaacccagtgccaggcatgggaaacctcccattgagttgttggttggggagtccatgagactcccaaaacattatagtttattgttgtccacccttggttgcctcttagaccttaaaattaagacaccacatatttagatacaagatgtagaggaacttggagctgaaactgacctggaagccttcttgagtactaactctaatggcatcagaaggggctgtgcaagctgccaggaataaaaagcatcaatagtcctactcacatataaaagcctacaaaccacaatgactggccaggcaagatattgccagtggtgagatagtggcacttttatttgcctaattggccttagagctccctcagtaagaggaaattcaggtctggtactataaacctagccaattacccgtggctgaggagatcatagactctgaaggaaaacccactattttcctaaaccaatataatttctgtcttctaaatacttttttttacttacctgcatgtaagtatagttttcacaactcatcaaagaaacttctttttgtaggagatggagattattacagagatctatagctgatcaaaatgcagagaacaattttttcttgttctatgggttcttgctctcttgtgggttccccaatcccaattggtatatctacaatgaagctcctatagctaaagcccaagggaaatcatggaagatgtggtagaaagattgtaagagccaaaggaccaagatgcttgctactagacagtgtattttagacatgacaaggaagctgtagccattaaatatcaacaatatagtgccctaaacaagacctgcagatgataacaccatatcacatgccaacagagatgggggaaatatcacaaagctcccaggtgaagagctataggcaatcaatggctgctgaaaggggaagactcagctctctccagggatgaggcaatttatagtttatccaatcctaagtagtcagccttaaatacacacatgcacacacaagcggcactaaatcgactcagtataaatatatagttataaatgcttatgtatgtgtgaataacaatacttattgaagaaaaagaggtcataactcaggaggaagttggtgaggacatgggaggggttggagggtgtagaaggagggtggtaataatgttgatatagtatttgtgaatgaatgatcagaacataaaaatattaaattataaaaataaaataaaactgcaactcttggttaaagggtgaaagtgttaatgataatgggattacctgggttcatatctgtcctgaagtgtgtcttcaagttctagggcagttgttcagccttgggtatgaatcataaataccatataatttttaccttatcgagaaaccagtatgttaacaatatttaacattcatctttaagttgtcttacattcttcctaaaaattcatttacatcctttataacatcacagatttagtgcccctaggtatgtttttctaattaatattaacatgtatctgcagctattaaaattcaaattttgctactggcaacgcctaaaattaactcatgtccttgttttaaagaaatgatactcttaggaccagataactaggaaagtactcatccttattcattctattgtcagatgaagatactaggagaaccgaaagaggtaaaggactcacccaaggccactcagtgatactggcagccctgggacttaaacccatataaactgattcctagccctttatttctttccagaatctcctacaggaaggaaagaaaaagggagtgggaggtgggaaaagggaactgtttacttagtgagctgggattgtcactgaagctgtagctcaggagggccagggcttattcggtggaatggtttcccatttgttccaaaatacttttaatctaccaaagtcaaagcctatacactcaacatgaacttagagggtgcttgtcatgtcttcagagacaaatagaaaggaactcatgctcactgggacaatatatagtttattagagtgtttctagaacacagaggacagctttttgtggttgggatggggaaaagaacagttacaaaccctgtcctatgtatgttcctcaaaattcatcaaaggttccttgttatctttctcccaatcatgtggtatgatgttaaatactcttcgaagtttagggttggccagccacaggtcatgatgacagccaaggactccacttaaaaaataatcactgccaattctaattataattaatgtatcttcatttctttctattctttctctcaaatgcaaacattgaacctataatacaacagtggatttagctgttggtagaggactttcctagtgaggacgaagcccttctcttaatcacaagcacattataaaccaggaattttggtatatgccaatagactatatttctagcacttaggaagtaagggcaagctgggacacatgagaccctgtctcaaagggaagaaaaggaaggaagcaggaagggagggcgggaaataaggaggaagggagggacataattgactaggagagacctgggttgtgggctacagtttcttctaacctctcctctgctggaacttactcttgaaccacttttaaaagaaagtgttgaagatagggtttataaccactaattgtcattctatttgactttgccaagttgggtgagaagttgggggtcctgctggcatgttcttctcacttttcctgctccctcaaaaaacttgaacatagggattatgctgctgtctgttgctgttagtaaggccctgggagctctttttattaccatccttgcctgaaaacaccaaataaacaataatctacaaagctttaaacataaacttcataataggaggatgacctaaaatactgttttgttttgtttttttccccagtgtactgcttggattggacttctctagtcaggaaagtgttcaccctaaggcaactttactaacctaggtacaaggtttgccttctgcctgcctaaattaaaactcctgagtcagtgactatgggaagccccaccttcaattctccagagttcttcctgctttgttttttcctactccatccccattctcagggttctcaagtacaccttgccctcacctatgcaagaaattgatttgtagtggggaaagttctggaaggaggcaagaagatcaaggtttaagacttaggttttccacttactaattgagcaactaggagaaaataattttactcttttggggactaaattgaccctctgaggaatataattcctgacctgctatccttagaaaactgatatataaataaaatgagatacctaatctcaagctgttttgtgaggagccgccaataatacacatgtgaaaggctactggaatgatgagagtgcatcactttaaagaaaaccacacattcaggcatcagaaactgaccttggtgggaaaaggatgggggaggaaaaaagcttggataagaagggaagagctggggaagggaaggtgaatatcatcaaaatgtgttgtacaaaactctcaaagaaataatatttaaaaaaaggaggaggaagagaaaccacggtaacatcgtgttttaaacattgcgaaaggataaattaaggggctgggctacactggtaatcgtctaattaatttgaaaaacaattattatctaatatgtagtagatgctcttcaaaatactaacaatataaatccctgcctaaataaagcggacattctacaatcatggcaaagacctatgagaaatgtttcttgtctttccagcctacaaaactgaatctaaagtttagttctgagcctcaactctgtgtgcctttttcatctttcccaattaaaatctgttttagtattaattacgcaagatcatttgtagagcctctgtggctaatttatggacatactcacaataggtatctcattcaacacatgtttattgagtgtctactacgtgctgtcactctgtatgtgtaaggatagcgaattaaagagatataaaaaaaattaaacaaagtccagttttagtgctcaaatggttctaagcctggtaaaagagagatagatagagatcctatgacacaaaactggagttgctgaaacagtttaacctgtaataagtgaaagctggtgctcaatacatgaaagtgtaactgtgtgcaaggagcactgagagttctggggcagtggtcatatgcagaaagcttcactactgaggaaacattagcaaaacacccaacaaaagcaacttaaggggaatttatttcagcccgtagcttggggtacagtccctgatgtcagggacgacacagcagcagaagtggaagaaatagtcatattgcacctccagataggaatgtgaaagtcaaatactgtttgactccctttgattcagtctggacctctaacctgtggggtgatacctctgacattcagggccggttacccttcttcaggtttcctttctggaaacacctgttgaactagaggtgttttcatggtgatctatccagtcaagttgtcaatgaaaattaattatgacaaccccacccttgtcagcttgaccccaaatatacgagtttaaatcatagaattccagccttaaccccttaaatctcaattttgctttataatgcaaaatgcatttagtccatcattcatagtcttcaacagtctcacatagttcaacagttcaatgtttcttctaagactgaacacaattttttctgagtccccataaaataaagatgttaaatatttccattatacaatggcacagaataaatattaccattgcaagaaaggaaatggaagggtcgcaaggaaagaccacactagtacatgactaaaactcagcagggtgaataacaatttctatagcccatttcttgctatttgcaacttatgatgaaattctctgggttcccgtggccttcagcagcaccatcccttcttctttgtcacctacagtatagttatctcctctattgggtcaactatacagcttgattacagttttcctcagaagacattccaaagttctggcattttcagcatcccggggtcccctatctaacttagacttcattttacaaacttcatgcaatggtatttcagaacctccttataaggaatacaactctattacatactgcctggcttcagtgtctttttggaattttgacacaggcttctatgatccccttactcttgaatccttcatgcctgtaaatccagtaccgcagaaataatgctgttaagtttctgctgccacctcacgatgaagcaaaggtctcttgaactatagctttggtggtctctgtatgctgattctgggagaatagttctcaaggcagttagttttaagcagagaactcttttaattgctttctctacttagactttctttttctagtgaattttcatcttcattagttgaaacctttactggctagagtttcaccctcagggcacctttcctattgccccagtgtagagaaagatgtttgtctatcattctttagtaaatctgaaaagcttaaagaaaaggaaatggtagataggtagatagatagatagatacatacatacatacatagatagaaaaataaatagacaaaaccaagatggaaaatacctgtaatttcagcatttatgtcgttgagtttgaggccaacctgagttacatggcagagacactattttacaatgcaaaacaaatcagaaaatggttggttaccatcataacattcatttcgctattgcaccaatgggaatatcttgccaggccagttgttaactgtagaccacagaagtcacagctgagtgagaataatgatttcttctctcctcctgaggaatgcagagcacccccacccccaccagtgctatgaaaactagacagtaaggtcaaagcttccaggtgaatgccagcttgatttatccatgttgcaagtatgtgatcttttcaatagacttactatcaagttctggagagtaaccaagagtattagcaataacccttaatgcttgggagaaccactgtaccccattagccaataattaaagacaaattaatctattcctagtattgagatttttatttgctagcaattgtagagtaactccaacacaactacttttatatgtattaagatgatgctaccagtagttttccacatgagatattcaaaagatcttagtgttagttatcccttcccgtatctcctccgtgacctacccttccatttccccaccccaattaatcattcctgttttattaatctactttccccctttatatcccatcccttcaaagaaccctttgcaccctacagccccgtactagtttcctaatctctatggacattccaaatgaaatatacatatctgaatatgatatgtatatttgtgtatgtgtgcatatgtgtatctgaatatgatatctgaatgaagttagtatccatgtaggagaggaaatatgtggtatttgcttctccgggactgggttacttcagtcatgacaattgtttctatttttatccacttacctgtgaatttcataattttatttttcttaattgctgaatagaatttgttgcacaaatgtacaacatttgatgtccatcatttgatggacatattagctgtttctatttcctgacgattatgagaaaagtggcaatatacatggtcaaacaggtgaaatccatacttggcagtgttaatggggccaataacctgtggctagacatgtcataggccctagaggagagcctaatattattctgctagatgtgcatagtattaaactaattcctgatgatttttgctatactcatagattgaaacacaagctagcttaatgggtcaagaaacaaaatccatctaacttttgtatacaaaaaaaccccctcatcttagctttaaagatagtcactaccctagagtgaaagaatgggcaaaatactccaatcaaatgggaccaggaaacaagcaagtattgctatcctaatatctgacaaaaatagacttcaaattaaaactatccagataagatttttttaaaaggacatttcactccaataaaggggacagttaagcaagaagaaattacaattctaaacatatgcaccaaattctggtggacccaattctacaaaaagtgaacttaacatgaattaaagatacagagtaacatcaacctgataagttatttctctgcttgtaaaatgagccaacccaaaccaggtatagataggtagataaagatagagatatatagatagatagatagatagatagatagatagatagatagagatagagatagatagagatgtgtatatttacatagatatagatagatagatagatagatagatagatagatagatagatagatagatgattgataggtagagatagatagagatgtgtatatatacatagatatagatagatagatagatagatagatagatagatagatagatagatagacagacagacatgtttattaggaagctcctttttccaattgaacttaaaattgacagcaaataaatatgtactaaatacacaaacacatgaagattggataacttattactagatgatgaatgagtaaaaaaaaaaacattatgaaataaatttaaattcctgaaactaaattaaaatgaaacaacacacacaggaaaaatatttggaatacattaaaaacagtactgtggggaaaatataaagctttaagtacctgtatttaaaaatcagaaggagccacaataaatgacttaatgaacaagaacaagccaaacccaaacacactagatggcaagaaataataaaaatcagatcagaaattaatgaaatggaaatgaaagacccctgcttcggggagaccctcgctcaagtcccgggatgagccaacgccccaataacttgagagaaacccttcttgatgcaatgtcacatgaggtttattcgggaatcagcatgctgaggccgagctcataacccacacaggggcagaggagatagaccccccagcagttgcagctgagggtttttaaagaataaaccgcaaagtgacaggatgataagaccataaagaatggggaagttgagtaaacatcgtaagaatggggatggcgaattacagctcatctcccacggaaaggttacaggctatctttggcaaacattcttggtcccttacactatgggtcaggcacctgggtgggtcatccagtggtcatcgttctctcaggctgaaggcgaaagaacaaagaactccatgctgggctttgtttctaggggtctaaaaacacattgaattggggtcgtacagaaacagtacaagaaatcaatgaaacttaagagcggatcctttgaaaagataaacaaaattgatatatctttggttcagctaactaacagaaaaagaggaaccaaattaacagattaaaaaatgaacagggaaacattataaccaattaatttaaaaattaatttaaactacaaaatttaaaccaagaagagctcatcaatataaacagacccataagaaatgaagagactgagacaataataaaaaggcctcccaattaaaaagaatccaagcacagagaaactcacaatataattcttccagactttcagagacaatctctagccaatccttcttaaattatttgaacaaacgaaacaaaaggagcacttccaagctcttccagtgaagccagaatcagtataatagccaaaccaggtaaagacacacaaaaacaatatccctgaaaagtgtaaattcaaagtaatagaaggtaggatggtataaagaggcgtgtccttggctaagaactaagccagaaaactaaactggattccattcacagtatgaccttgggcaagtggattaacatctcaagaagtttcaacaaaatactccctttgactcctcctctatctagaaagaagccccaggaaaagtgcatttaatctggcacagagggaactctgtaaatatgtactgaaggtgaaaaataaaccacctcctctctgtccttccactctaccaacttcctcacctctgccccttgtactgttgccctggctccatttgaatgatttttttagtccttttaactagctttccttatctgcaaggtcagcaagttacacttgaaacttggcccctgggccaaagcatactggtcagtccccctccaacttggttggggataccagattctggtccaaagccccaatactccttcgtttctctatctcgtggtatgtaggatcttctttgggggtgagaaatgttttgaaggtcttatggttctggcactggtggctgttttggaatctgagaactcactctggaggctatataggtactatttgagaatgtacaaaacataaactctaccccagccctccctatgctaccccgagcctcatccagaaatatctgctcttaggtctccctcatgtttccctcctgagtctttttagcaggtagtattttcactagttagtgcaagaattatctttctaaatgtatgtaagtcacctctttatttagactgggaatgcttaatccgtaaatggccaaacttaagagaaacaggcaaaagggtattataaggacagatatttcctaaatcgaccaaaacaagataaaacccatcaaatgcaatgccccaaagtacagctgaaagaagccccagcaggtgttgaggaacattccttttcctactgtctctgacccttcactgacctcacaaggtttcccattgttcattatcattgtaaagactgaccattgtaaaacaatggctttatctcagatgtttgtgttttacattatattactttctatacctacttactgtaattagaagggaaattgggtaatttaggtattacttaagtaagttttttgcccttttcaggcttcggttttcttatttgtaaaataaggagctggagcccagtgtggtattgagggactataatcacaactcttgggaggctaaagccgaaacattataagttcaaagccagcctgggatacacagcaagttccaggccagtctaagctacagagtgaaaccagtagatggtcccaactctctgaagaattctccatcagcaaccactagtttgcaatacctcttcagttaggggtgtgacttcttgggcccctcctttatccaaggtgagattttgtctggcttaatcttgttctagtcttgtacacacagtcccagctgctgtgaactcatgtgtacaattgcattgtcatttctggcaaacactgatttgctcctgatagttgcttcctctgagtcttgcagtctatccactctttctttcataatgatccctgagccttggggttggtggtgtgtgatatagatatctcatttagagcttagcaacttatagcctgttattgtttgtatattgtacatttatggatcactgtgtgaatcactactgaaaaaaagtttctcagataagagttgacaaatacaccaatttatgagtgtaaaaatgattgagggagcattttattactatgcagtagagtagtagtagacttactggaattttcatttgttagcttgtggtatctggagaaggtattcatcattggtgagaatgccagctggtctaacccactatgaagtccaatgtagcagtttccaaaaaaagctataaatcgaactaccacatgacctagctatatcactctttggtgtagagccaaaggactctatattctgctacagaaatacacatccttattcttacttactcatccattgctgatctgtttacaataaccaggaaatgtaaacatgcccatcgatggatgaatggctaatgaaaatgtgctttatatacacaattaactattattctattgtaaattaaagtccattgtgaaattcacaagaaataattctaagtgagataacccagacccagaaagataaacaccacatgttctctttcatatgtggatgccagttttgaatctttagatatgtatataaattgaagtacccaaagagagcagaaaaccaaagaggagtcacaagggtgttcaatgaaagagatagaataaaagtactgtggaggggggaaaggaaagtaatagaacaggaagggttaaatgaggggacatgggagggcagagtagaggaggaaacatggtgaagaataactagcactaaagacttgaaaacactgtatagacactactgcagaagtttcctgatatctgtacatatatggggtctaaatggagttaataagtatttattgaatgactgctaaacataaattaacaagaggctaaaaaatagctatattttcccttaactatgatcaagaaatggttaaaccagtttattctttcactttagactttcctcatgctaggatggggttaagtatttcctacctctttctcttccataatgctcctggtgcttctgtcatcttttcccctccatgtctgttctaataataggctcactattgaacagactgcttcttcttggcattcaggaagcaggctctgtgcatatggtcaattgatttgtttttaatgcatctattattatgaattgccttctggtttgaactgaaaccaaactatgcccagtatcctttctcttccatgcttccactttggccatctgaaggtgtcaacattcaaattcatttcccagtaatgtgggttcccatcaataccctccttgtttatggacaatgaaaccaaagtcttctctgcctttggatgtttcactgtcgttgttactgacactatgagagctcctttccacaatcaattctacttggctattagagccaaggtaatgctgcatcatcagaagccttaagttaccctcataaagatgaataaggcagagtgaaggaagggaaggccttcttgaccatactctcaatgtaccatccattctcaagtagtaagatgacttggacatagggcacaggaataatgagaatgcccatctataatgggaacttctgtcgtgcaggcatacatgcaaatagagcactcatcacattaaataaatacataaataaatcttttataaagatctgttagccctgatgtctgttgaccaagacagatttagagatttatgggaaaaatcacatgcatttggtacctgttttctatacctctaattagttcaagcttctttctatactatcactaccacttttttctccaggatgcaactaggatacatctctgactcaggaaatcttcactggcactcttgggttaactttctattatctatgacacaatatttgaggatagtcaacttttaaggaaggaagggtcattttagcccattgtttctgagactttagttcatagtcatataatgccactgcctttgggcctttgtcattatagtagatgatggagtagaaaatggcagagaacatgcttatttcatggcagccaggaagcagaaagacaagaagggaggagccacagtctcaatactcaccttgagggcatgctcccaatgacttaactttctaccacaaggcactacctcaccaaggttccactacctcccaacactgccacaagctggcaaccaggcctttaatgcactgacttttagaagatacttattgaaatcgtagcacttgcatagaccaaagaaagcttattagtctcaacgttacatttactaattctgtgaagtagacagaattgtatattgcagataaggaaattaattgcttaaggtcacactagctgcagtgaaataaccataagtagaacccaggtctccacattgcagcgctctagccattaagaagcacctgtaccttcaaaagaggggaggactggtatgcactgcatgggttactagaatgatgggttacataaccctgtctcctgggtggggcacatactttgaaattcacacaaatgggcaaagatacctgttctacctcttactggctttgtaaacttaaatgacttaacctcttgggtcctgtttcctcattgctgtgaatattatatgacattatgtatgcagagggcctagcacggtgctaggtttacaggagaacctcagtgagtcctgccatgcctccaccctctgcattctcattccggtgatctcaaaacccattcaaaccaaaagggaaatagaatttagatagctggaatcaaaatgacgtacagaaatttatgattttactcagttctgggactggaacaaaactctttttagggtttcagtcaggttctttgcaagtagataccaagtctagagctgtcctagaggacagctggtaatgtgaacgatggatcccctggctggaaagcaaacctttagcctcagcactcagcatgtcgatggtttctcattcctcatggctgaagcattgtggagttttattaaaatgcaagtgttctctgggagaagcgtcatacatattaagtttttggcctgattaactttcactttcctctctctatgagtagagtccttctgtgtctctgtatcttgggatcagggcaggctctaaagcaggaaaccacctccaagccacctgttaaaaactccactccatatccaaagcccacgttgtacataacttaccccagaaccctgtcatggcttagctaggtaatagctttcctcatctcagcaacaagttctacactcctgtgttagatcggggaggggggggcttctggcttttctgtgtgaagacttgccttaaagtttactttttatttgccttccttcatgaccttaaagtaataaatgactgatctgagttgtggttcagtttggaggccacaagaagcaagtgataaggtttgctacttgtcaataagagagctgctctattcatttacacaatgcctattttgtggactggcgtgaccgtgtgatctgtgaatttgcttgctttttcatggaaccacaagccacaggacatccctgtcctgcctgccacccaattgtgcttaaagactgtgttcattggcatcagatggagcccaggcgccttgagctgcgtttccagccagcaggcagtttcacctagcagaaaggttaatcagattccaggtaaaaatggaactggggttcaccctctttgctagtgcagcacagacccttaggggaggcagagttgcttggaatcaccaagtaggtgagagttgagctggtacattgtggctcaccagcaaggcagagtccccttcccccaaactttcccttactgagtcttgggcattccatgggactctgaggttactgcctgaagtgtgggtgtgagagagatggtgttggaaagatatccctctgcactcttaaaagcagaggtccaggcccaagggtccagcctgatcaggatgtcaggagctgtgctgcccttgactaaagtggcagctagatctggaccccatttctttcatatatatatgtatattcttttattattattattaggtatttatttcatttacatttccagtgctatcccacaagtcccccacaccctcccacacccactcccctacccacccactcccacctcttggccctggcgttcccctgtactggggcatataaggtctgcacgaccaatgggcctctctttccactgatggccgaccaggccatcttctgatacatatgcagttagagacacgagctctgggggggtactggttagttcatattgttgttccacctatagggttgcagatccccccagctccctgggtacttcctccagctcctccattgggggccctgtgatccatccaatagctgactgtgagcatccacttctgtgtttgctaggccctggcatagtctcacaagagacagctatatcagggtccttttagcaaaatcttgctagtgtatgcaatggtgtcagcgtttgtaggctgattatgggatggatccccgggtatgacagtctaatgaatttatgaaattcctaggcaaatggatggacctggagggcatcatcctgagtgaggtaactcaatcacaaaagaactcacatgatatgtactcactgataagtggatattagcccagaaacttagaatacccaagatataagatacaatttgcaaaacacatgaagaacgaagaccaaggtgtggatactttgccccttcttggaattgggagcaaggcacccatggaaggagctacagagacagagtttggagctgagacgaaaggatggaccccatttcttgctctctggaacagagaagcaagaataacctgaactgtgttctgcgtcccgccggggcatgggccgggcaccctctggtgctttcgtgcctccctcctttcctggcccggcccctggcccagagtctgccctggccaagtctagacccggccctctgtggctcctctgggctccaggttggcgcaaacaaagccctgattgactgcccggaggggcgggccccgctgcgcctcctcccctcagtcccgccagggatttgccgggaagcgcgggggtagggggtagggggtagggggtagggggagactctgaggggtgcgtgggtctgtgggtgtctaagttccaggcttgagaagattgtgcccaccctctgtcccaggctgcactctctaggtcaccggtctccagtccaagtgggaacacagggactcccgagaacagggtggggtctgtcacggaccagctctagtcttggggttcccaggaccaatctagctgcaagttgcttgaaagcaagagggagtggactcaaggagcaggcagggtcttccttcgaggctagaggttgatctgtgggttctgggacctgcggggaggagaaggtagggtaaaagggtagtttctgctccgtttgctaatttaattcgtcttccaagccatctgaacaagaataggagtcagtaatttgaaaagggagtttggggcggcagcaaggctagagtaggtaggcgagtaagaggaggaagggctggggagaagagcgaggttgtagcggctgcctgttgaggaagaggtgggagggaggaggagggggaggagagagagatgacgtggggagacgaggaggggggttggacgggggaggagaaggagagggcttgaggggaccgtctgtcgcgggacaggctggccagctcgggcgctgggaggaggaggaggcagggtctcaggcagccgcggcggcagtgctcggagcggcaggagcagtagcagcagaaacaagtaccagccagacaacagctcctccggcaagccacagtcagtcccctagccgcgatggcgctgccaagcccggcgagcgaggaagctgaggggccctgtcaggaggcaaaccaggaatatcaggagccggtgtgtagtcctgtgcccgagccggagccagagccggagcccgaaccggagcctgaccccgagccggtgccagtgcccccgcccgagcctcagcctgagcccgagccccagcccctacccgatcctgcacccctgccggagctgggctttgaggctgagccagtgcaagaacccgagcccacgcccactgtggaaacccgaggcaccgcgcgtggctttcagcctcccgaaggtggcttcggctggatagtggtgtttgcagccacctggtgcaacggctccatcttcggcatccataactctgttggtatcctctactccatgctactagaggaggaaaaagagaaaaatcgccaagtggagttccaagcaggtgagtggcccacgtgccccacctggcattgtggacaagggcgtccgcccccaccgtcatccccatacctgttggtctaaagcgccctttcgaatcgcctttctcactccttcttgctagggcatgggttgcagggctataggcagcctgagcaatggagacctaggctgaagtggtcccgggaggtgaaaactggagcattcattgcttacaggcgagcaatgaactttttgccctgggacaaatccagactcaccttttagattgtttaaagtactttgcccgtgtgtgctggggaaaatatttggaggatttgggggcgggagcgggaagcgaagtcatgtagacaggacagtaggaaggttgaaagggctcagagataaacaccgaacaacgggtccccgcagcagcccctgctccttttggggatcagagcggttttctgtcaaaacccactttcaggaatcctgatgactcttcgctcagagtcaacacatggcaggcgtgtgtgtcgccggagagaaagggaggagtgtagtggggagggggggtgcgcgcgtctctgcctgctgtgggtacggcccagtcaggccgttcgatcgcctgccgttcccggggagcaagcggctcaatgtgcactggaagccagcctcaaaggaggcaggaagactggatacagaatgggtcctgcaactcagtccgcacctcagtccgcacctcagctgcgcggtttctagggccccacacctctgttatcggatgggggcttctttctccctgaagttaaaatgttgacccatcattccagctttggcttgggactgactcgggcatccctaagacttggcagggttggagacatagccctcaccttacaggcacgtggttgtgtgcagactccctagcacggagaccctccagtgacctccggaaactcaggctgttcgctctgcagaaatccctcagctgttctgttgagaggtttctggacttagccgggagcttgagatatcctttcatgaaaatctggctccctccctgagctgttaggatagctggaagtgtgcacaccatctactcaagttccctacttgggaaaaaagtgtaaaacatagtgttcccttggagttctgggggtcctctcttgctaaccaccaaaagagggtccttttggacgatcaaatgaaatcgaaaccttgaattctgggatgcccactgtggattacttttagacatgccctccctcaatcaaggaggtgtgttgtttgcagctttgctgggctgtctggcagaaggggctttgggactcttgtgcctcagtccttgtgacccattggcaccactgcagtatacagggcccacttgagaaaatctcgagtgtactcagcggctgtaaatggcacttcataacaacctagactacacggtcctgtagtggaggggtccctggaccccatgggacaacttctgggtggaaggctgcttctatactccttgggaccacctttttcctgctttgatgcagattaggggctcttgggaaagcagccaggctaggccctcaggatgttgccttggttacttgggggttgggggagcacctgctgagagttgccttgtggtttaaggcaggccagtggccttcagggtcagtggcaaagtttaggcgaaaatttaaagggaagtagtcgaggctgagctgaatttaggcccctgtatttatgtgatgtgatcaggcctagcgctggggccttaggagcgtgcaataaaacttggaaaaaccactattttaccaggaagaggttcactgctggggagcagacttcaaagtaggtgatcataggagactcagggggagggctggcagggactttccggtcagtacctcacagtgcagctggagggggcggtagtgctgtggtctttgcagaggtgtggctagctagtgtgtatgccaacacagactaggtccactgaggggctggagttaccggcttaaactctggagagtattggtcaggaagagacagaaaggaatttggtatgtcccaagggtctgagaatactttggcgtgggtccttgttgtggtatatcatggtttcactgacgttgtttttgatagtgagcctttgcagaatgcctctgtttttattttggaagccagtaacaccctactacattcttgcaaatattttacagaaacatttcatcctcagaattacctttcttgagaccctcggatttctgaaggtactgtttattgactatcgggcaggctcttgccatgtagccttgggtgacctagaacttgctgagtagcccacaatagctttctgcttgtgattgtcctcctgcttcaaattctccagtgctaggattataagcatttgtgccaccatgctttgcccaagtcacaatttagatcttgatatttccaaacatctttgcctgcattcaatttcttcagtctattcagagttttgtggccacctatgtcacagccctggaatatgaaacagggaaaaacttagtattttgctactgtctttatgagccagcatttgcccaataacgagtctgggaggacacttaaggaagttggtacattgtttatttctattaatatgatgtcttacatggcattcattcctgacaatttattaatttgtatttggaggaactctgaaacccaagtgttgttgttgttgttgttgttgttgttgttattgttgttgttagacctaacactgtctagccatgaaggtatatgtaatagcttatttggtctaaggttctgaagtagtgaaagtcccagagaaaggtaatttcgatgtctacaagacaattccaaacagggctctctggcacaggtcaaggaacagatagggagaaagtagagtttgggctgtcctagaacaggtaatatacaatctttgtgaatcctgtggctttgaggttctggtacgtttccaggtatatagtttgtgtcatttcttcagcccatttaagggaagccaagtctccctaggagctaggtctgggaggactgatggcaaagggtttttgagagtgaaacaaataactgaggtctaggctgggggtaggcaggggcggggtggggagaacaggaaagaagaaagcttagacttttgtagaagtcacaggaaattaagcatctctccagcccagaaaaggcatcagataggacaggaggcagccagaccattttgtgggatataaataccaagtatggtttcttgggacaacagatgacccttacaatgggaaataggagcaagactggataggttgctagccctagctcactcttcaaaccctaagtagaggtaaggttgaggtttaagttgagcagatgaggcagatttagccagagttgttaacactggatccaaactaaagtctgttttaaagtgcttcagagtaagcccattaccttgcttcttcatttccagtttaccactgagtcatacatgatgagaggtccttttattggggagttgagatgtacagtccttggaaattcctgagggaggcaagactagggctctcactactaaaaaaagtggacaatagtaaggaaggttcactactggtataagatggcttaggttggtgatctaccctggttagttgcttttcctgtttctatgagcttgggcagaaacaagaaaagtggatgttgctagataaccagtccccacataggttctttgcttaccttatcctggcgatctacccatctaccaatttaccccagctgtaatagaatgtacatgcacccatgtgttcagacacgtgtgcttgtgtgtatagtgggatagataatgtctaactggcctattaattagtagagctccttcaaacatggtgtctataagattgaggtcatggttttagtcacttgttcaggttaccgagcttacaaacaaaaatattcttcagttaatggtccatgtcacttatgccggtgacatggatagaagaattagatagaagactggagataactccctgccatctctcttgccactgcggtaatggaggttggggggggtgggcagtatggagcatagagcccagcatggctgcctgtgctgcattccacagtgggatttctttgtcctttagctccatacttctgctgaacaccctaatgatagcaatagcatagctgtgataagctgagaactgagtgaaggctgtgagttgctaccagcactttctagggtatccttccagaaatattttgtttcttgctatcattcaaatgcacagcctacctttgaagtacaaatgatgaaacataacattatcttctaacttgccttcaaatttcaaagtatcgtgggtattagttatacaataagtccataaagcaagccctcattctttgttacagacacatcatattttccaatgggtatatcatgaattatttaatcagtgtcttactgacagacattcagttgtctccaatattttcctataggctttaggatgaagcagcactagatggagatgccttaacatatggttcctggacaaagtttcagtttcttggaaattttattagttttctaatacaaaaaatttcatcgctgagatggaggttaaatgagacaacatacgttcagcatctgacatacaccttggcacctactaagcatttgattaagtgtgagttcttttcctggctcacgagccttccccatccattatcctccaattgcatgaatgtgggtttaattcaagaaaataggtctttcctgtgtgctggaatgatctccagatgagccagagtagtgtcccttaagtttacaatttctttgaaaaaaaatacaacattcaaaataactatggttattgctaagtaggaaaaaatgtgtgttgtattgagttgaatattgttatcactttcttgtggtgatgtgggcaaacagagaagaatgtagaatcaggggaagcttgctggtaggcctagaacttgacatagggtttagctacatggaaactcggcaaaagtaacagtacagaagttgagaattaaacaatttgtaaccaggtcttgtggtgcaggcctataatcctagcacttgaaaacagcggcagggggatcaggaattcaaagtccgattggcctgcatagtactactttgtctcacacaaaacaaaactaaaacccagaacaaaaaaaaaattagactatttggttgtgtctcagattctgtttttgttgttttgttttgggttgtgttttctccctctgggaatccagtgagtcactgttccccattaggccctacacagcaggtggggtagggtggggtggaagggtaggagaagaaaaaatactgaggacatttggagagaaggggcatggggcgaggggatgtctgggcatcaggccacaaaatgagatgcctgaaaatggcctgtggcacatcagcctgggccacaccacctgcttttctatgtcagcaacctagacacttttttctaagcattctgaggccaagaagagcatagtagcaaaagctctcagcctctcagtttaggctcagagtggtgtccagatcctgtgaagcccaggaaaaagaagcttgttaactcatctcttactgggtacattgtaataaacatctccattttttaaattcatggaacaatgaagggaaattgtttaagctcatcatatgtcagtgtctttggtcacatcaagtgctacattgatggaatctgagaaataaaaattaatataattttgtgtctactaggggaaagtttactggatggaagccctgcatagaattcctgttccctatttctaggggcagaaaatagaagactggggcaaatgagagtagacagtgattctaactctgggtttccaattccatgcttcatgggggtggtaatgcacgagttttctgaagctgcaatagaaaacctcagtaccatctgaagtttaagtgttaggtaagaagcagaatatgcagtaggagaaaataaggaaccaggagttgtgccattaagggaataaaaacaagacttatggaggggaagatttaggcataactgagaccttgtggctggaattcagaaaatactgtgatcagtgaggagagaggagtaggagagaggaatggaggagaataggaggggaggggagaggaaaggagaaaagaggagaggagacaaaaggagagttctatagtaagttcgttgtaaccttgctaagtgcattttcttttctggacttcggatttctctccttctgaaatgagaaacttggaccaatgaacagtttcacaaggagaccttgggcatgatggtgatgggactggggaatggcaaagaggttaacaaaagagcttcttttaaaatggaaacatagcctcacagatttgaggaaagacagctttcagagatagtaactatccatagctttaaccctatattcttgaagaattccctcaagtgaggcaaagagagatggcaagatggtttagcaggttaagctcacttgccaccaagcccagaaatcttaagttccatccttagagtggaactatagaatggcaggagagaactgatttcctttgagttatcctttgacattcacacagactgaaacataagggcacatgaatacacacacacacacacacacacatgcagatatagatagatagatagatagatagatagatagatagatagatagatagatagatagagatgtgacaatttttaaagagatacaaaaagagaattatgtgtgtatgcatgtgtgtatacttgtgcaagtaagatcacacctcaaagcacagttggtatttgttagaaccaattatgacatactgagttagcatcataggaaatctttcctgaataatctccactctaagactgctttccagggactaaagaaatgtcttggtgcttaagagcccttgctactcttgcagaagatcttgattttgattcccagcacccacatggtggctcacaaccttctgtaactccagttctaggacagtagcactggatacactcatggtgcacagacatatgtataggtaaaatactaatacacataaaacaaaatcaataagtcaaaaaattaagatagctttccagatacacacaaggagaccagagtggttttattatttaagcctgtgttttatgtgtagggatcctgccatagagccagcttgaataagcactgatgttcagccaaactgtctagataaacactattcactagctgtttgtccatgcacaaggtatttaacttctctgtactgttatttccctgtttgaaaaaggaagatatcaaaatcccttacgatatggttatgacatgagcttataaactggcctaggacagtatctgacacattgcaggagctacatacatgtttgctgttcttggcatctatctaattatctgtggcttgtgaatatacatactggggcccgaaagagcaaatgtgatcccaggttagcccagtgatagtcaagaattggggattggttgcattgttaagataccacgtgggctactctcatgtagcccaagctcaggactggattaggaccttcagagtccccaagaacaatttttagactgttaaatgctgcgagatgacagagttggattggtaaatatatacttttcctatttggaagtggttttaacttattgatacctaaaattatgctcaatccacatgtggagttatcatcccacaccagtcatactaggccgtacacttctgctctaagtttaggaaagaatcaataactatgtatggtctatatagctacacacagcagttctctacccaagcagttccatacacagcagggagcgctgtatcctgttcctactggcttatcttgccaggcctcatggactctttgctgattggaaccgcccacacagtacttggaaggattattatcttctgggagcaggtgaggacatatacctgaaagtctcaataaaacaatcctggcaggaagctctaaatattatcaagtaaaaatcctagtgtagagttgggatgagaaagaatggttaggatcctctctgccacttggtgatgagtggagcaagagtctcccagctctgactattccagtgacttcaagtcagtgaccttagaaaccttgatatcattatcagcttctatattgctctgtgcatcagcaggttctaaccatccaagtggtggacaataagacaattatgtgttttaagaaccaaaatggtctgggggattttttttcccttgacatttcactcatggaaagagtagctccaattaaactttccattggcccactaactaaacaaatggagaaacatagtggtatatgtaagggaggtacagagacttttgtttgacatcttccctggagatggcaccactcacattcaggcctgtactatctgcccttttcataaagtgtctcaaacatggaaggctcaggtggaaccggtcagaccggatgttgtgagcctacgccttgtagaaagggaaagatagatacacacacagccacgggagagaataaggaggaaacaaatctattgttccagcctctaacttgaaaaaaacctacctatggcttccagagtatcaccaatgaacactgttaaagaatgtggtggctcacctatgtcccgtgaatggacttggctggttctccagacaggaatagaaacctcaagactacattccaggccatggctcaatagaggctagggctggccttgaggccctcttctttttcatggacttagtctgagcgttgaaataaaagatgacttgggatgggagctcacaatgacaatcccaaagtttaactcccctttgtctcacttttctatattctatgtggcccaagatttaacattaagtagacagttttagagccctggcattactgtttacatgatccacaagccttggccaagtctgaacttcactttccttctctgccgaaaagagggcagtggaggttataatccctgcctctcagctgtgtgataaagttcaaatgatagaatgaatgtgataaacctttgaaacctactttgaatattccacatgaattatcatcatgatcatattaataagcaaatcttcaaatttgcatatgtcgttatgcatgtatatgtggactgagacatttacccactgtgcatgcatgtataagcaactccatctatgtaaggaattgtatatacatctctgattttaagcttgaactcatgacacggaccattaaaaatgcatactcctaaaaaaagtgtgcacatacaaacagcctcatagctgtgaaatgaatgagcagaccacagcattcatcttctctctagactggtcttctaggagtctgaaaaggacgctctttctaaattccccaacttcatcctgccagtgtctcctttgcccttgctggggcctcttcctggcctccatcttgtttgcacgttagcacagctgctgctaaaattcaggctgccctgtgtggcatccacatgtctggagagcatggggcctgtccagttgctccacgaatagcagcaccacagctccttcccgcacaatgtatttatagccatggttgcaaatagctgtcaacattttcagagtatttttcaaaacacagttaatccagccacagaaatagtcactggcccaaatgctctgaagctaaaagaaattaaacctaaaggaaattgaatctcacatctctcttcttctctttctcctgttcattatccctcctgtgacccgctttggccacttcttattccatagatcactgagcttaagtaaggtatgggggatatggtaccatagggtagatgtgcttcagagaacttagcatcatcctagcataatgctttaagagaaaggaagaaaggagaaagaagaagaagtaagagtgttgaggattagaagaatgcacataactgaagacttcgtaattgtcagacccacaacaaggaagccgagtgcccattttgaggccaactagagttttggttggttttagaggatcccacacttcccacagtctgtggggtgtggaccagcatactgtgctgcttctttgcagggttgaaacactaaagtgagcccctagtgatggagttgaagaggtaaacatgaatacaggataaggtaatctcccaggaagggaacaggcctgaggctacggtgacacgggtttaggtagggttggaatatcactattttcaaaagcagaatgctcttgaggatggaaaagaacactgttaatatttttctagcacactaggcataaaacaggattgtcataggtaacccaaaatgagtgtccgttgtagaaatagagtgtgtttgttacagctttctcagaaaaaaaaaaagagcaccataaagactcctcccaaggtgccttgagaaacgtatgcatgtttgtgtgtgtgcagggggagggattgttcattatgtgtctgaattaaatttgtatgaaagtatgtgagactgtgagtatatctaactttgtgttactatgtatgtgtatgatatgtgtgatgatgcgtgtgtacatggatatatagtaagagtgaatgaatacatgtgcatgtgagcacatgcaagatagccagtcctcacccctgtttcactgaattgcagactcagttccaggacagcagtcacatagtccactgccttatttcatatgcggggaaaccaaagcatgggtcataagatttatacacttccaccacttgtttggcaatggcaaagggttgactagcaacagtcacagtaatcctgattgggtgtcagatgccaatccatatgcattgaagtgaaagcccggcgatttcttaaaggtttttgcaaacaatgggtacttggcaagtgcaaaaaagaagcttcttaagtcattttgaagtgcctgaaaagactaagcttgggtgccaggggaatatttaaccaatggctggttcccttggagctgtttctctgaaggatgctgttaagcaatggaagctttgaaatatcacttggtgccatccttctcatccctcaccctaaagatgttatttgtcttagagacaaacgttgatctcgagtagagatccactaaaactcttcacaggatttaggccagacatatgctgaacattttcctagactgacataggatacaggacaacccctcttccttagccccttattcctgccccatcacattggactccaaggcaagagaaatggctacagatgtgctaacagggttctggatggaggctaagaatgtgtgtcccagaagatagatagctacctcattttccctggattgtttggtctgtagctgaaggatagccccataacaatgaagcaaaaacaccaaaacattagtcctcatctgaacagattgaacctgcttgagttttcatttttctgtacaaaggatgagacaggactatggggtgccatagcaaaggtcaggaggaactagtccagttttttgttgttgtttgtttgtttgtttttgtcctatagatactccagtttggagtcagccagtattcactgggcatttactgtgtgcctaccatcaaactggatgtttacataagtgaattttatcattaaggccttacactaaccctgtaaatacactccaagaaataattaccagtggcttagtcaaagtaaaatggctaataacggcagaatgggagttcaaccacaactttcttgactaaaagaagttattggtagtctacggcatgccaggcattatgctaaaatttttccacagattatctcacttaatcctcagaataactctgtgggggtctacttcaccctgtgatattttccatataaagctattaaggttcagaaatattcggtcctttatccaaggcccagtgttccagcacttgcagtaaaggattcaaatctagtcttcttgactctcaagagtcaacccttccctgcttctctgtatagtataggcttctggatactaactccctctcgtactagggattaaaacctggggttttgagcatgcggggcacatactctaccactgagccacagctcccagctttcaaataactcataaagcctcttgcagctctgacattgtagaggtcaaccagctctatgataatccttccctattaaccccagcagccttacagttacttgactgtgttctcctgttattcttctctgcgcatctgggtctccccacgtgtaatgcctctataccagtagacccagtgaatgcatccttatcagcttagtctgagatgctctagagcttactcggcttcctcacttctgcatgtcccaggagatccctggttcaagctaactcgttagactacccagaaggtccaggtccagcaagagtccctgcctcaataagtaagtgaggagcaacagaaaatacctgtatctaccttgggcccccacatacatgtgtatgcatgtgcatgcacatccacatatacatgtcaaaaatctgagttctgccactgtctgcaagttttatggctaccctctgtgcgctttactactctgagcatcaattgctgcattgatgaaaatcaggctatttttcacatggtttttgtagagagtaagcacatgcatggaggttagaactttcagaagttgttggttttttaggtttgttttagttagttagttagttagttagttagttagttagttagtttttctcttcttctacaatgtgaaccctggagatcaaactcaggtcattaggcttggcagagagtgcctctgctcatggatccttttcattgacccacagttcctaacctgtgtcaagaggtttgaaagaatctagaggaaaagaaaatgcatgccaaaacatttatttagatttgtgttgtgcattttgaggatcagatggagaaatggcttggacatgtttgatgggctcttatgagctcctttctcaggaggagctgcgggtgtgactgctctgctccctgcctgcccttttatacatccaaaaatgcaaatctgcccagcctagctaacgtcctggccccctgccccgtttgctctctagactaggagaccacctgcttctgtaatctctgtgacaaagaatcacagggttctttttccttttccagaagcaaaacttgccaaggttttatgtacagagaggctttcttgtttcgcctatatgagtggtgccacccctgggtctatgcaaatcaagacagacacatgtggaaaatcgggcttgtcacgtgatgttattattagcccattattgtgggtaaggaaactaactgacctcagagaaatggcagataataaatggtgagttctagttgtgtgtgtttggatgcacactgaagtgggtaagacgtttatctgaacacctttgataggtagacaacccgaatttaattttcagatcaccatcagtgttcaggaataaaataaaactagacagtaagcacaatacaagttaagcattaggccaaggagataccaactctgcactgatttgtatgcaggtgcatgtgtgtaggtcagaggtcaacctaaggcatcattcctcaggagctgccctccttgtttttgggggacagagtctgtcaatgggacctgggtctctctgctttggttaggccagctggcaagagaactctaggtatcgacctgtcttccattccccagtgctgggattattataggtgtgtgccaccacacttggctttgcatgtgagttctggggaattcaaatttatgaggtcctcaggcttctgcagcaagtactttatcagcctagccattccctcagccccatgtccgttaacctttctgtctcctttattcggtttgagttttctcaagaggactcatttcactaaccacagcatatttttctgggtgttgtgatgcaagagggtcaaggggagatagagaatcaagttgcaatcctgtgtgaagagagataactaaacaccacacttgagtcaagtaagacaatcggtgataacaacagctaatagttgacaaaaggtttcctgaaggaagaccagagtgcacacttaacataatgcattatagtctttttttaattaggtattttcctcatttacatttccaatgctatcccaaaagtcccccataccctcccccccacactcccctacccacccactcccactttttggccctggcattcccctgtactggggcatataaagtttgaaagtccaatgggcctctctttccagtgatggccgactaggccatcttttgatacatatgcagctagagtcaagagctccagggtactggttagttcatattgttgttccacctatagggttgcagctctctttagctccttgggtattttctctagctcctccattgggggccctgtgatccatccaatagctgactgtgagcatccacttctgtgtttgctaggccccggcatagtatcacaagagacagctatatctgggtcctttcagcaaaatcttgctagtgtatgcagtggtgtcagcgtttggaagctgattatgggatggatccctggatatggcagtctctagattgtccatcctttcgtcacagctccaaacttttcatagcagccttatttataatagccagaagctggaaagaacccagatgcccctcaacagaggaatggatacagaaaatgtggtacatttacacaatggagtactactcagctattaaaaagaattaatttatgaaattcctagccaaatggatggacctggagggcatcatcctgagtgaggtaacccaatcacaaaggaactcacacaatatgtactcactgataagtggatattagcccagaaacttaggatacccaagatataagatacgatttgctaaatgcatgaaactcaagaagaatgaagaccaaagtgtggacactttgccccttcttagaattgggaacaaaacacccatggaaggagttacagagacaatgcattatagtcttaaggacttgataagtgtgtgtgtgtgtgtatggaagtgaggagcaaagacagacccaaatgttcctgtctttcattctaggcacattaatcaaagccagatccacgttgtcttctcaggccttctttgcatgtactttttttaaaaatattttttattattacgtattttcctcaattacatttagaatgctatcccaaaagtcccctataccctcccccccatttccctacccacccattcccattttttggccctggcattctcctgtactggggcatataaagtttgcctgtccaatgggactttaaaggtacaatatgtttggatttgttttacaaatcgttgttcttagcaaccaaggtcagagattttggcttttgctttgactgctaaccatacccctaagaaatcccacaggaagccccaagatttactttgctcctggacacctggtaaatgactgtgctctttccttgccctgtctatgagttctaattggaattgtgggggccaagtattctttcttcctctctttcccttggggccgatcaggtttctgagctccaggagagagctgcactctcaatcatcccctgaccgaccaaggctgcaattcccaaagcaccatctgcctcctctgttttccaggtgcaggacagagttcccacacatctgtcctgtccttccgttggcagcctggccttcccacctccagtttccagagccaatctaaatcagtcctctgcactattccccttcaggaaaaaaaaaaaagcaaacaagacaagttcctctcttgccagtccaataacactctgagcaggcaggcagctggcatctgaagtaggcagctagcatggtgagtcctagcagactggccaacataattatccagggaatggcgtctggagcttgcttgcctcatacacagagaccctactttgtgaagcaaacacccagcaagagaatattatttttgagggaagaacttttgaacagacactgcaaatgatccaattctccctcagcctctggcctcagcctcgtgcttcaagtcatgcccaagagaagaactcaacctatttcttgttgtcagaagtgcagattttggcccaaggcccaggtgaggaagaggatgacagaatgacagagttacctaactgtttgcaacaaagaacgcattcctccccacccggccctgccctaacatgtcattgaatgcctcttcctgtgcaccctcagtaagcttttgcccttctcttcctacatgaagctgttattgcttattccaataaaaggttatctaacatgcaagaaaccttagttgtgtcctttgagcctgaccacatatttctttttggtttttgtgagttttcagaggggcctactagctccttgtatgaaatattcaggcctgagtcatatgatggtagttacatggggaaaaaattggacccagaagtaatggtgcaagcctttgatcccagcactcaggaggcagaggcagacagatctctatgagtttgaggtcagcctgatctacatagtgagttccaagacagccagaggtacatagtgagactctgtttcaagtaagaagagagagagagagagagagagagagagagagagagagagagagagagagagagagagagagagagagagaaagaaagaaagaaagaaagaaagaaagaaagaaagaaagaaagaaagaaagaaagaaagaaagaaagagcagacaaggaaggaaggaaaaagtgaatggcgatgttgataaccatagttaagtatgtattccaaactcagattcatagaagataggagtataaagtccccagtggcaacctcagctaaccagtagaaccatttataaactgtttaaaaatacagtttctctgtagttaaagataaactcacaaaatcagatttgctaaagtatagccttcaactcaatattttaaacaatgttgacactggatatggtgccacacatctgtaaccccagctatctggctggctgaggcagaaaaatctaaaagtcaaggcttacctggacaacttagatatggtattgaattttttgaaatgcaaaacttgctaaggatgtgactcacgacatggcatgtgcaagatttggggttcagtttcaaataccacacacatacacatacttacacacatacacacacacagcacatcatacacaaacacatacaccacactcccagaatcccccccacagtctcatatccgcacacttacacatcacacacacaacacacatatacacacattcatacatacactcacacacatgtgctcacatgtgtgtgcacatgtgcgtgcacatgcacacacacctactgggtgattctgataaaagagatccatttaccaagttgagtattttgattgtttcctatttgaggaaactgaggctcagggaggcagtgacctgtaagaagtggccagacaggaaaagatgagcagagcagatgtgccctgggcctcattgatcccctctttgcatagaatactcatattacatttcctcatcttgcttgatcttcctcaattacttgtcttcccatgctttcataactgagtgttctaatggcaaaaccacatcagactatatcttaggactctgagttcttaagtgtgatccctggagctgatctcttgctgggttgatggacattattcgaccatgtgcctcagcttttccagagacaaagggtttgggcaagagagagatgtggcacccctcttttacaaagcaaagcaggctgcaaggtttcaagtgtttgtgttggtagagatctgctcagagctatgactgctagaacttagctcttgcgctgagaaagatgcaaagcctagtgggagcaggttatccaaagctcaggctgacactaagtgtctgtttgtttatctcagggaattttggccccattcccactgtattatcgctggcagcctccttaagtacaaggataatgacatgtttgaaaaaaatgcctcaaacatcaattagcctgtattgagacaacccctgggagttgtttcttcatgtccttatgttagctgtacttatcagtctccaagcactgtgctttaccctgctcaaatctctagaacttttcagatccctggcccactgttctgtaggggcaagagaggtaagagactggaaagatggctggtgggaagcaaggcataattgacttgttagtaattttcatttggatacgttgagatgcacttggtgttgagcagaagaggggactgtggatgaagcactgattgtcattagacctgggctctagcttcatcagtgtcatgttcacttgccatgtgattatagaccaagcccttactatgcttcagtttcctcgcctacacaatgaccagtttagaccgggagccttttccactctaactgaatagtggtaattcaattactcaagttgtaggattgggggtgggcacctaatgagtgatgctcattccctacattcatggttctctattcatctcattgtgaatctgctaaagaaagtacttatttacctgcaaaggctcaaaatagaagccccaaagtaattagatctgctcttgcctgattgcattggctttagtgagttacatatcagctccggctggctccactgtactctagatagttcaaatacaactaacagctgcttttctgatcatatgtgagtttctaaggacttagatatcttgacctttcatggtcccctctgtggttctcttgttctgccctgcaagatctattagtttttcagacttcttcagccacacatccctctaactaggtcacctgctggcactggctcagtgtcagaaggctgtggtttctctgactggaaaggtcttgattcatcctgttgtggggaactctttagcttggcagctgttttgttctggagatttttcctttgcctaacatttctcctgtccacaaccatcacccttcatccaaacccactcctccaagcctcacccctcagccctccaggataaagagatgagctttgccttacaacagggcagggcagactaccagaaagatctaacctttttccatcaatggtggcatcaaaatctagcttcaggaagtttagccaaaaccacaactaatgagtacatgaactaagtaaaactcatgcacttgctatgccagcaagcattaagacaagacctctaatcaccttcattcaaccaacttgctctcactaagccattcctattgagaaattatgtacttccccattacaagccccagagcctagcacagaggacagaaggattatttcataaatatttgttaaatgaataatgacaaaataaatgaagacttaacagacccaaaggccagtggaaatagcactggctgatgtaggaggctgagcctatcactaatgcatactgtaactttgagtatttccagttttgtttctgggtctgagtctctatatgctgaactgaatggtcccttatgaaacttccatatttgtagttcatgaatgagacttatctgtactcctgtgtcaacaaataccactctacctctgtcccaaggataaaaaagaagcctttgtctttttatcagatgatactgagttcgtgctgatgggataaatggacatgatccttcaattgaaacaaaactaattttagagaagccagtgcctccaacagtgccaatggggtggctgataggatttcatgtctatgacttaaaggcaaaaccagccagcttcccatcttgtcccttctaccttggtgccctgtaaaaagtatgttgatctgagtgtgtaggagcacatctgtaatggcagcactgcagaggttgaggcaaaaaggttgtgagcttgaagccagcctaggctacatagtgaaaccctctctcaagaagtgtttccctgggctctggtggtggttggagtcagtaggcttgtagagatctgggattccttggtcatgacagaataaaattcttgatttccagtgaaagcactttttaaaaagtctatttaaaactcccatctataatgttattaactaacacaggccagtctacctagggtgaagagagaactatgtagaaaaccaaaaatagcaggccctctcttacttggctagtccctttctgtccctctggattgagtctctgtgggctctgtggttaaagcacatgagctttgaaggcttacaaaaaaatcttgctaagagaatttccagtcctgaaaagttatgatcctataattccaaatatctaacaaataggaagatttgtatgttctgagtcaggctgcagctgggctttgggtattcgctacatggatatgtgctgagttcctaggggagacagaggctgctttgtaaggaaaggcagaacatatttatccatctgacaaaagaggcgtgaaacctaaaatgtgtaatcaatcatttggacgtggatcgcccacaactctctccctcgtacagccaagctccatggtcaaacttcagatttagactagtctgtggggggacattctctgactctaagactactcagagttacgatgtgcttttccagtgactcctctgcagttggtttcaatgttcgatttgaagcaaggaacaaatgactagaccttgctatacttggctataaagaggcatgagaagttgacagttatagttagggagaaaccttttgatcctcagagtcaagtatctcaagaatggattgtagaggaagcaggtggatatacataaagcaggattgcttctacagatgtgcctattgcttctacaaatgtgcctatttgcattgaaatgtcatcctgctatggtccttcccacctgttgtgggacaaatgtctcatagaaggatgttgacagtaaatgtgccacgctggtcaaatccctttggcacacttaagctttccaggtgttataaacaggagggaacaagcctggatttaaatgtgttatgtcacaaagtaaagaaatgtgttgctgttagtaatgggcttggaggattctatagttgggaaaggggccaaaggaggccctttatttagagagcgggaaatctcaatgtccctgtctactgttagaatactatttgcactaaatgaccagtagcaggttcttttttgactcccttagatcatgatgaaatgatcagaatagagttggcaagctccctgggtatcctctagactggacatgcattgaggtggaaccagccaattttcaacaccccaacaaatatcacaattttgaatgatggaatgagcagggatccgcacagatgggtgaaagcctttgacatgttgggactttaaagattatttattacaatggttttccaaaacagtcagtataggagccaaacatggtggaaagcaacttttaatcctatctcttgggaggctgaggtagttaaatttcaaatttgaggccagcctgagcagtataatgagactctgtctcaaaaaattttactacattataatccatcagtagaacaaaaaattaatttagaaggtaacaatttccatataatagacataaaatgcattattagaaaatggcaacttgttcttttgtagggatgattactgttttatgaaatttaaggtatctataagtaccgtatatatttttaaatttatgtagcagttttacacatgtaaatgtttttgtttttgagacagggttttttttgtgtagccttgtctgccctcgaactcactcaatagaccaggctggtcacggactcaaaactcagagatctgcctgctttacaagtgggattaaaggtgtgcaccacatgtcaaagtcccaacatgtcaaaaggctttcacccatctgtgctgatccctgctcattccatcattcaaaattgtgggcaatcctttcttcttttgctagattgggagttcacaagattaattcccaaaagatacgaaggaagggctgccattctccaggccagtgaagagatgatgctctagggacaaagcccactgatatatttgttggggtgttgaaaattggctggtcccacctcaacgcgcacgcacacaaacacacacacacacacacacacacacacctacactatatatggtagatatgtgattaagtcatacaagtgaacactccacagtctgagttaaaatcacattctctagttctctaacttagtcagttgtatgtccttggaggaaatgactcagtctaatcaagatcaagataataatagtattaccacatagggttgctggtggtttccctgaatcaatatgtatgaagtatttaatgtgcttggcatatataaatatttgataactactaactatcatcaggattatatgccttgtatgctgtatactttaacatgctttgtctcattttatctgggaggagaggtttcttttctttctttttctttttcttttttctttttctctctttctcctcctcctcctcctcctcctcctcctcctcctcctcctcctcctccttcttttggacaggattttgcctaggttctgaaactcactatatagcccaagctgtccttgaatttatgatcctcctgctccagccttccaagtaactaaaattacaggcctgcattgggctgacctccagagaaggaactgtcatccttattttaaagatgaataattaaaggctgaggggttaggtgccttgtctaaagccatgaacgtgagatttattcagttatttgagaattgtctgtggtgtggaatagaaaattccaacactcctagtgggctctcctgatggggagagcaggaaggcttgctgatggggatgcagtgagagacagagtgcatccagctgcctgggataatagggtcagtccagcccttgcagacatagggtgcctagtggactagtaaacaacataaaatatacctcctcctacattttgcttctggtgcacagggtcaccagcaggaagagaaggaacctggagaggaaaacaccagggcatggtattttttatgtgcgaagcagccaagaataggtctgtgacatgtgcaggagtgtgctatatggaaaaaggaggaaagtgtacagtggccagcctgctcacaaaaacaaaaaggtagtgcacacctttagtttgagtgcttagaaggcagtggcaagtggatctctgtgagttcaaggccagcctggcttacagagcaagttccaggactacatagtgagaccctgtctcaaagtaaataggtaggtaggtagatagataggaagaaagagaggagagagagagagagagagagagagagagagagagagagagagagagagagagagagtcatgactaggagagatggagagatgactcgacaattaagagcactcttgcagctgatgcaaattcgtttctatcatccacacagcggctcactatcatctgtagcttcagttcttgttgatctagcaacctcttctgacatataaaggtaccaggcatgaaggtggtacccagatacacatacaaatgttcatgcatgcatttttttcttccatatctatttggatagtgcattgatctcttgatttactagccctcaaaacttcatcagatgagcaagatggcctctaacactaactctgtactcagggcagtggtaggctgtagagcaccaagtcttttccaagcttacaatttaattaagtgaccatacttgattttgtgtgaattgtagtaacagcatgatgaagttgctttaaaattaattgtgttgggtaattcataagtaggatgaggtagggagcagtagggggagggggaagtgggccacaaaactgtcatgtagcacaaggacactgattagggaagaaagtgcagagaagggaagtaaagagctgaataagaggtgggagaagatactttggtcctttcctaactaggcagcaagctgcctgaagagtctaacatgtgggacaataattttggccacgcctaaccttgggaaagtagtgaattaaaatataagccttcatcttcccagagaaagatgataggaagagagaacagtggaggtgctttcagttgcttgaaattctgctctagatatacttgaggtgtccttatatgagagctgtatttcaaattaagatcattatcactcctcctgctgctactatggctaaacagatgtggtgccaccaatgccaccagcattataaagagcctacaccttccctacaaggatcacaactgagtaagccctgacaactatttctgaatcttctattctaatgtctaggtgggcagttccctggaccagcccctcccattgggcttggttactggtaatcatttgcacctcccttgtaagccaagcctctcctgtacgcagcaggaacacaggcattcattggtttttctcctacctggtaaattccagaatgttgagaaattcataaggacattcataagccattgcgtctgatacttcattatactggtagaggaacagtgactcagagagagacatgggacctaacaaggatcccactgtacagcagtggcagaaatgtcacaagtgcatttcacctagtttagaggtcagtgtgcatccctcacccctccaaaaccttccagtcacttgactggtctgtcactcaagctgttgtcacattgagcctgcaggattcctccagaacagtaaattctcaaccttagcagcctatcagaattccctagggagcattaaaaatactggcaccctggctctatctcatcaattgaatcatcatctccaagggaggggttatagtttttaaaagctccctaggtgattctaatagatagtcaagattaagaatcattgctctggggaaaaagagcctgacatctgtgagggagcttgaaggacagactcccagtgaagcagcttttacagacatgtctcctttcagccagatcatttagcacgtcctccagtctggcatgtgaaatccctaagagttaggttcactgttatcttccaaagtcaaattgatcttcttgttactgctttcacatcattacatctaagaaatagtttactttcagccatcttcttctttttaacatcataaagacctctaaagagactgcctgtctctagtgggaagcctataaataatttgacccagtttctggatttttctcagtggtccactcacaaggcatatctctctagctccctttcaggagctagtggtgagtatttaaaactgtccatcagcccccactcccaattacttgctactcccatacatatagcccacttcctaagcaccaggctgttaggggcaaccagtagaaagcagaaaaaggcgcctttgagcagaccgtgatcctttgcccccccccacacacacaccaagcctattcagcttctatctgactatcatgttggctttgagccataataatgtgtaatgacttgcctagggtgagaaagcagagatgagtgcctctccccactctgtaagtgccctttattttttagaattattaaactggggatacggctgagtatcccagcttaatatggtatggtacttgcctagtacatgtgaacccctagattcaatccccaacatgtcaaagaaataatactttagaaaagatgaaagaaaagagttatattctactagtaaacccaaccattagtgaaaataagtaaacaaaacaactcacagggcccatgcccagataaagagcaattaataactgctcagggacaaccagtcttctccaggaaggagaccctaattgcctattcaataccaagtggccaaccctaaagaaaagtacatgcaaacaacactaaacagactcagtaacctgtagttacatatttatttattgtctattatattgcatatcatatatgtaacagtaattaaagaaaaagagctggtgaatttgagagtgagcagagaagggagggggggacaagtgagggagcaatctctgctttgtcaccttaggcaagtcattacccaacactgtggcccaaagccaacttgataatcaggtagaaagctgaataggcttgggggtggggttcaaaggctagagggataagatggaaggggagatgttgtagtattttaattacaaataaaataaaataaaatccctttcaacttacaacataaatctgtcctcaaataataaggcaggtaggcaacacaaaatgaactctgtgggtaggctggtttcctttctgcagagctttgcttctggtttgttttggttgggcatttttttgacttactggtcttttccatgtttgtgggtttgttttattttcattttagtgagggttttctgttttttttttttgttgttgttgttttgatattggctttggttcctggaattttttttttagagagagagagagaaaactagggtacataaaggtgagtgggtaggaaggtggggatgattgatctgggaggagttgggggaagatcaaaatatattttataaaaaacattaattaaataaaaataaaaataaaaatcatgttctcttgctctctcctgctcttcttttgctcctgctctggcccttcccttcctttccccattcccttcccccctctctccatgtactcatggctggcctctacttctctctctctctctctctctctctctctctccctttctctctccctttctctgcctctactaccctcttaactcccctccccatgtcatgaataaactttattatatacttaataataataataatgttaaataaagtgaaaagcaaaaatataaaactggaagcaatcattaatgatgtttggcaacttgtagtcactttgcattttcaagtcttttattctcagttttattgagggttaattgacaaataaaaactgtaaataagcaggttttacaatgtgatgatacaagtatgtatacattgtgaaatgattaccacaatcaacctaattagtacatccattacctcattacccttgtttgtggtacaaaaaaacagttatgatttatgctcttagcaatttcaagtatatattgccagtactataaactaccatgtatacattaggtctctaaaacttactccccttgtaatgaaatttttagcctttggccagcatctccccatttctcccaccttttagtccctggttaacaccattcagtctctgtgtcaccatttctagatgtcacagacaaatgagaatgtcctccagggttgttaatgttcttgtcaaaaccaatgttttcttcattgttaaggttaaataacattgcattgtgtctatgtaccatacttacgttctatattcatttatctgttggcagaaacttgggttgattccatattgtggctgttatgaataatatcacagcaagcatgagaatgtagatatctctttacacatattgattttgattcctttggatatatactcaaaagtagatgtgttgggttgtatgacaattctatttgtaaatttttgaagaaccgccacactgattttcataatggtggcaataaatttacattcccatcagcaatgtataagggtttccttttctccacatcttcaccagcacttggtttctttgttttttttaaagggccatgctaacaatcatgagattcattatgattttgtttttattgatcgtctctgttgacttatgatgttgggcaccttttcataaacttattggctatctgtataccttctttaaaaaaaataggtctctttagttgctcttgaaatccaagttttgtgttttgctatcgtattacgggaggtcagttacaatagtcacacatgtttatttttgcttttgtgctttttaccaagagcaatgttagggatcttttcctccatgctttttcgtaaaatctttaggttttacagttaatacattaacctatttcaagttaatgttgtatatggtataagttattattgaatttcctttctcccctcaccccaagtgtttgaaattgaatacatggctacacctgcagccctaatttaattctcttgctggtgcatttccagctttctcagcatcatttatcaaagagattttcatttcctaattatgtattattggtgccactgtcagagagttgaccatgtgtgtgtctgcatgtgtgtgtgcatgcgagagtgcatgtgactttgtaggttttctattctcttccatttgtctgtgtttttggttttatgatattattttactattttagttattatcaattcgtactatgatttcgagacagaaagcataatgcctccaagtttcttctttctcaaaattgctttagctattcagaatccgtattttctgtgacaaatattattgtaatttttttaaaaaaatgttgaatctgtgtatgactttgggtagtgtgaccattttgagaatattaactcttctatcccataagcgtaaaataccaattatgtgtgtctttgattgctttcatctatgtcataatggtatactgatctctcacattcacgactgaatttgtttagtaattttattgttttgtgtcattgctgttattgttatttattatttatttatttagtgtttggtcatgatatatttgtgggcttgcatgctaaggtgcatgggtgaaggctagaagataactttatggagccaatactctcctacctatatgtgaattctgaagaacaaaatgaggtcatctggcgttcatggaaagctcttttactcactgagctatctcacacccattgttttgtatttgaagtggtatttctatatcctctctatatccgatttctactccttcctctacccacttcacctagaaatattaagtctggactgatatcctgtgggcatttaaagtgtaaaatcaaacctagagtaataatgaaatttctttgggctagtactatagaaaaaatagtttactatattcactgcagaggtgcttattggtgtggagaaagtttggctgcatcaccatgaccctcccatcagcccttatggatcagtgataggccttcagcctggcttccacttgtaactttcctttctcctctcttctcagggcagcagctgagaaatctcctggaaaggagggactaaagtaggatcctcaagccttgtgggctggagctgaatagcatcatgtcagtcacagggcaggtgatgatggccttcagaggaacagttcatagagaagctccaatcctgcccagtctctacagttttggaagagggagcaccacctttgggtgaagttcacccttccctcactgaatttctgattcactatgagatctgcccttgtgccctttaaagttgagtcaatgatggcaaggcttgcatggagtcttagttttcccatccaacaagtgggtacactaataaacctactattatctctctatgcaattgtatagattgcaggcaaaattcagagaataggatgtctctgtctttctccatccaggtcccaacagtagtagtcattgttgcaagatttaaaggctgtatctgatattctctaactcttactccacttctctgccccatgtttaggtccatgttttctagaccttggtgattaagataattgggaaggaaagtcaaggtgtctggaacaggaaaagatctatacaatcctaagaaggaccatgataatgaggtcctgggatgaggaccctgtaaagaaacaattttaaaggagaccaagttaagcctcaggcagagactctctgttcccctcttcctgaatcttctctctttaaagactcagggtcctaggtggacctgtgggtatagaaacactgaataccatcactggacaaagaaaggacatagtgtaaactaaaagcagaactctatagcacttataagagtatgctttgcagacctcaaacttcagagaacagaactggctcaacgttttggcccaaacactctgaaatctagttcagcatttgtgctaaggtcacagttgctacatgacagagtcactaacatccaactattcctaggagacacagaactcctctgactgctggctgaccttggttttcatgaggccttggtggccctgccaaatcttccatggagtacagggaaggcacaaattcttccagaaagataggaaagactcctttcctatcccaccccaccctccccccgtctcccatgttcacccacactcaggcttatattgcagtcttttgtctctcccagcatccctcactatgtgatctcatctcccttaaaaaaattctcatttcaaaatccactttatgatatgcttctctgaggtcccagactaataatacaaactctgatcaagctgaaactgaatacattggctagagtctgggcctgcacctagggttttgtgcaacaagaagccttgggccaactttagagagcagtaggctttaagtcaccctaaggtttacagaaacattgtgaatgacctactgtactgctctcctttactccaaatcacttgctgagacaaatacgtttgctagttttaaaacaattatttatttatgtgttttacgtgttatgtgttttacgttttgtctacatgcacatctgttcataatgtaccttcctggtaccctcaaaggtcagaagagtgtgtcagatcctcctaggctgaagttacaagatggttgtgagcctgcatctaatgctcttaatgttgactcatctctccagcccccatgttttaaaaaatgccccaacttaagttgtcttctgtgtatttttgtggaagatgttttaatttcttttttttatatagtaccagctttattataaataaatgacttcacataaaaagttctaatggcaattacacttagaattactcattttaaaagttgtaatgagttatgtatgtatgaatgacagtatagatgtgcagcatccaaaaaattccagaaagcatttagacaagtagtagtatcttggaatcctcagaacaacagtgtactgaaaatgaatcccagacaagtgttcctgtatttccaggaacaacgggcatcataacacaggcattactgacccagcagttcatagttggtcatggaactgctaaagttagggtcacattgtttactttgagaggaaaaggatggctattgtcctccctctgttgagagttgtcactcaaggtactcacattatggccattcatttccaaagagatgacaatttcatcctctccataaagcaggccacctggaacttatggatgctatccaaacttgctctctaattacactcagataataaaagaacattattttcttggaacataaatctgttgatcccacaggaaataacaggataagaaaatctatagttgaaggtcagcatcctggttacagaactgttatttcccaagtgtatgtcaccaattctaatttctatgttgttacaaaagatctttgcattctcactattgaccaatcatcaaaaaacactgacatcactgctggttcaagtccagaattccaaaacaatagaaaaacaagagaaaacctgcctaagagcacagttaacttcattatgcaaaactccaggatataacaatcatggggaacaggaaatagctcttatttctcccccttttctttttccttttcgtttattgttttgttttgttgttttttaggcagcatctccctatgtgactcaaactggcttgaaatttacaaccctactaacaccctcctgggtgctaagactacaggcatacatcacgacacctgacaagaatctttctttaatcacattgtagtattgtctgagatatactcattttctcttgctttccactttgaatcagaattcagagaaattgaactcctatttagccactaacaaaccctataaccttgtataaatacctttgaggtttatgactttccttctctgtacctcatggttttggatttttttccctacaacatttgttacctcacttatggtctttaaaacttgtgtgctcaagggtttctaaattacagattacaatgatatgttgggaatcagggaggacagaagccaataaagagtggggggcaggtggaggaaatgggatgacagagaggagaagggagggaacgggggataagaaggaaggagaggagagagaatgagaaagagaggaaagatcaggagagggagaggagaggagagagaatgagaaagagaggaaagatcaggagagggagagggagagggagaggagagcggaggggaggggaggggaggggagaagaaaggcagaagagaaaatggagagggttctcaaaagttaaacatcttgcgtgccctgcctccagcttcacctggcagctccctcacatgcagtgctaggcaacacacatggtgacctactttgtaaggaagctctttctggagttgtctcttctttaccttgctggtctgcccacaacagctctgggactaaataacagatataggtacagatgacatacagatatagatatatagacataggatagataagcagacagacagacacatacatacatgcatgtatacatatatacatacatgatagatacatacatacatacatagatggatagatacatacatacatagatagatagatagatagatagatagatagatagatagatagatagaagacagacagacagacagacagagatggatatggaacagatgatatgtgactctagcatactgaaccaaatcaaagagcttataaggttgaaaggcattctggtccttaactttgtatttctagagaccaacttcagagatttgaaactcaatctgttacaagtcttcctatgtgggattcaggcttaaatccatcgtgagggagattaggatgctttttattccaaactacaactcctctaaatctaactctgtcccctactgtggccttcactttctcccatttactcttataaaggtttaccttctcctgagcctgggagcttgggctctccttctatacttcctttctgcctcttttcaccttcctcggggtctttttttaaggttctgagataacctgagtttaagcaaaaacgtctcaggcattcaagagtgaatagacatcattgttacttgaattttctagttcccaggctcctctggggctttgggtttctcgtcacagaggtttcttgtttccacctcccaagtgttaacatttcatctggagcctttcattctggtttggtatacttattccagcacattacaactcttactgaaacttttgtagatctctgcacagtgagggagtctcaccatcctagaagaccacaactaaagagaaacagaactaagcaggagacagaaaagtagttgttcttataatcagggtgtgggacataccactccaaaattcaaaacacccacaaaaaactaaaacaaagctcccacaaaaattaatgttcctcagaaacaccatctccaggctccacacggggatctgacctaggaaatctgaagtatttagatcaatttcttcttctgtcttgcatgacagtaagtgacaatgtagcaggagagacagaccagaactgctgtcagtaagtaacatgaagaattctcttctcctttagagacctatactcaagtgatgtgggtacttgtcttcgtgacagaaaaagaaagagtgtattaaaagacatctttcacatagatttttttttaagtcctgggattcataggaagaaagaaactgaggcaagaaattaaatatacccaaatgtgagtataggattttcaacagagaatcatgatggtctttatagtaggcatatgtgttttttgttttttatggcttctcacatatgtattgttttttatggcttctgaaagggttactatggaactgttttggttttggtaaatgaaatcagacattattcctgatgtgcactacatagaattgcagctgatatggcaaaaccctaagtcacaagagttgtggggaaagttaaagtgtttttatgccttaaacatctttacttaccttgtaagcaaaggtttggtgttaattttaaaatttcagaaaacatctggaacgacaagtaaggccatatatgacaattacattagcctagactttgtagtggtttacatgatgtatgacccccaccccttaatcttgggcatttgaatacttagttttcagttaatggggaaatttgggtaagtttaggaggtgtggtcttgctggaagaggtgtgtcactgggggcaagctttgaggtttcaaagcctcaaactggtcacagtttgcttgcttgctctctgctgtatgcttgtgattcatgacgtaagctctcagctacctgctctaagtgctaggtctgctgcttgcttccacactccccaccctgacagactcttaaccctctgaaactgtaagcccaaataaactccttccataagttgccttggtcatggtgttttatcacagcagtagaaaaataactaatataggcttaaagcatggtttattgctattttaacgtaaaatatctctctctaaagaaatattagttttatgtcaattttttttcacagcaagtgttgttagttgtactgaaattctttgtgtgtgtatggtgtatgtacgtatttagaggccagaggttgacctcagatgtcttcctctataattctccaccttattttttgagacaaagtcattcactagtctgaaacagtccagtttaggtagactggctggccagcaattcccccagtatttttctgtctccatctccctaacactgggattatggatgtgatgtgttgctgtagccatgttttacacggatgctggctatctagcttatgtcttcatgcatgcacaacaagcatcttgcccactgagccatctccccgacccatcatgctacattcttgattcttgaccggcaagaagcttcgatcagattcttttccccttttcattttcccttaatttacacataaagatttatttattgtatataagtacactgtagctgtcttcagatgcaccagatgtcattatggatggttgtgagccaccatgtggttgctgggaatcaaactcaggacctctggaagagcagtcagtgctcttaactgctgagccatctctccaacccctgttctctgtatttctatgcttcctcaaaatcagatgtaaggtccttcatttctttatggcacaatttctccacatataaaatcagagttagactcaactgcctatcttttaagatagaagcaagattgttagcctggggaagaagagatctgaataatttgaaattgttcagaagacaccagggacacagatgggtaggaaaaatgcaatgaaaaaagtcagcggaagttccagtagattaacaactgtctccctcacaccacagtgttcttaactttctatgatttttactgaggacttcagagtgcagaagggaggttccgtggatttgaaactgtttcactttctaacttccagctgcaaggagagcctgcaaaggtatgcatttcagttttgtagctttggtgatggtgtcagaagtgaagacaatgggaagcgcatatcaagttacttcaacatcacttaatagaatttttgctctaagtcgaatttttaccagtttactaaggtatgattaatatacaataaacaacacattatatttttgtgatttgattagttttgacaaatacaatcacccactaattcaactcagtaataaaccccaaaagactcttcatgctcttttgtagtcagtcctctgttgaccatcatccccaacccaaagcaacccctgatctgattcgttcactataactaagtagctttttaaagaattttatgccagtgagatcatatggtatatattctttcatctggagattcttgacataattattttgagattcaaaataaggtgtgtagtcacattttgtttagttttcttgtttgttttgagttttagagagaaggtcttgctataaaacccaggctggcctagaactcacaatccttctgcctcaggttcccaaatgcagggattacaggtgtatgtcattatgtccagctctcactttattactgagtaattttccccattgtgtagctacaccacactttgtttttttgtatttatctgtgcatatgcatttgtgttatttccagtttgagcctattaaaaataaaagttcccggtacaattaattgcagatcacttatcagtatttttttattgcacagatgacttctattttcaaaatatttttttcatagcagaaaatgacttggcgaatgttgccttgctgtttctcttttgtactgaagactatttttggaagtttttgttgttgttgatatttttattccctttgatgttgttactcattgttgcacctccttgaacactgtgaatgggttttgaaaatccgtagagaaagacattcagctgaacatttaagactatgtttaaagatttgtccaggatgaaaatgaaagacccaaaattttcttgtaaatatttgatatttcttaaaacaaatcagtaaatataataccaaataaagaatttctttctcttaaagataactttaaagccagacagtggtgacacatgccttcaattccagcacttgggaagcagacagatctttgtgagttcaaggccagcctggtctacagagtgctttctaggacagccagggctacacagagaaaccctgtctcgaatttttttaaataacactttataattatatttatgaacagaaaactctgtagtgtagatttaatgatggttagtggcaatagattttggatgcagaagtatgtctctccagtaaggcaacagattatgtcatatctgtcattgtcattggtcctaacaggttctaccagcttagctggagcactcttgtcttctgagttaacctgtatgaaggcaaaggcatttttcctgtaaagcagacaccccagcgtggccttctcccttggactcgatcttgtaacgcagaacaggcaggaggaccaccagctttatgggggtccacatcatgtgagcccaccgccagcagagtcatgttctccacaaagatagtaacaatattgaccactgttcaaaggatagatggtctcttagtggggatttcccctttaaaaggttttcttctcaactcgggccccacagcctctgcttctcctcctgctttgtctctgacctgtagctgtggaaaagcttagggatctggtcctgctttttgactgttctgggcctatgtgaaccagctaaccatagagggcaattttggaaagccctttgtagctaaagccggttgtaatggggacatttgacaagacaaatgagatctcttttagcctaggtgtcttttctaatgccaggttcttaggccttttctcagacaggattcaccacctttcttggcctcctacttcttcacaagagcagagatggaagccactttcttccacttggctttctttcagcatcttgcttagtggaggagagcagtagtaatttccttttgatcccattgaccttgataagggataaggacttcaccgatccccagagaccaggagactgtgagtagacaagtgacaatcttaaggcagctttagaaccattgcatctgggaatatggcagcttggagaactctggctcatggccaatggaatctttcattttaggaaaatgctccagagagatggtgcagtgtaaacactgttaacaggatatttggtcctccacatggcaatggtcatactttcactctactcttattttcttaataaaatgtaaaatggcaacatgggatatttggagatcaacggtgactcttttttttttttaatattttatgtcttatatttacagggtttaaagaaattcagaattattattatattttacagtaactatgacttttaaatcccattattgtaatggtttgcttaatgtagcctcataatccaactgctgtacagtgattctccagtcatattcatccattctcctctatagtcttcccttcctgtgtgtctcctcatgttttttattagatattttctttatatacatttcaaatgctatcccgaaagttccctataccctcaccgtgctctgcttccctacccacccactcccacttcttggccctggcattcccctgtactggggcatataaagtttgcaataccaaggggcctctcttcccagtgatggccgactaggccatctgctacatatgcagctagagatacgagctctgggggtactggttagttcatatcgttgttccacctatagggttgcagaccccttcagctccttgggtgctctctctagcttctccattgggagccctgcgttccatcttatagatgactgtgagcatccacttctgtatttgccaggtactgacataacctcatatgagacagctataccagggtcccttcagcaaaatcttgctggcatatgcaatagtgtctgggtttggtggctgattatgggatggatccccaggtggggtagtctgtggatagtccatcaagggtgactctttagaccatgaagaaaactcttcagatatttgccttggtgtgggaaggggcagcctcgaatagggaatcccagccaaaatctttgccctgcactctggagttccttcatatgacctacagaaagaattactgtagataaaggcaagagtcgataccctgaagaagcattggccatgaaccgctgtgccactacaggttctggggtccttatccaacttacagaaatgtagcctgggcctcaaggcaggcttgagctttctgttattattccgagctgccggggaagctggagttggaacagtctgtttggtaggcccaagacagtacatgaatgtattaggacagacccctctgggaggcaggaaaggctggatgaatcaaaaggagatttaatgaggagcacactctagttttcttccccagccaaccctcacactggggagatcattccttagagcagaggtatattgttctctgcttgctgcaagtttctgagcatgtacaaggtagccaagtggtcaatgaaggagcaagataaaggtggggaggatatggggaccaggaacccccaaagctgcccaggccactaactgatctgcttacaatcatcagcacttccctctctgggccctcccagcccccagggaatgagagctgttttgctctcctggatcaggaagaacaagacttccttatctggtgggagagggctggtgaataccacctccaagtagaggggagaagggaaagcaaagagccaagaaaaccatagacccagcaggcagcaccattcctggggaaagcctaggaagaagggggcagacttcacccaaggaccccagggttccaggagcccggatgggcggtggatccagagtccataccctcctcccaccaatgcttcaaagccttggtgcttgtagctggtgtgaagcttttgctttcattgtctgaacgagatttttctacaaaacaaggaaagccaaacagccgctcaagttacagagtccctcctcattttatactcacgcgcgtgtgcgtgcgtgcatgtgtacgtgtgtacgtgtgtgtgtgtgtgtgtgtgtgtgtgtgtgtgttgtatgtgcatgggcacacaagtgcttcaacatgctcatggaagtcattttgaaggagttcattccttctacatgtgggtcctgggaattaaactcaggtggtcaaaattagtagcaagtgccttggtttgctgagtgatcttggtggccccagatttttgttttatccatgtatttatttgtttggagatatatatatatatatataaaatctatctatctatctatctatctatctatctatctatccacatatctatttatctatccaagtatctgtctatgtatctatgtatctatccatatatcatttatctttcttcctatctatctatgtctatctatctatctatctatctatctatctatctatctatctatctttttatctatccatccatccatctatctatctattttatctgtctatttcttttacatagggtctcaagtagccaagactgatcttgaattcttgatccttcagcaggcatgcaccaccacacccgcttttcctgcatgtattttacttggtgtctacagctgcttccagtgtttccattctgtatggctgtcctcaccacacacagtgattctctggtgcctgataaaatcaaatttgctgtttcccaagatattttaccaagcttcacgtttgccgcagatactctaagattccagtccagggacactagaggcacaataaaacacttaccaaatcaaagggagtcctagttcatgttagagcaggatgttgatctagtagtgtaaaggagagctgccatggatttagtattgtctggaagcccaacctttctcacagtagtagtaatttgtgacacatacattttagtcagtagctattattttaagattttttttcttttaaaacatgcattgaaatgtgatttctgtggtgtggaatacagtcagttaggcaggatctagaatcacctaggagactagcccctgggcatgccactgaagggttatttagtttaggttaactggggtagaaagttacaccttaaccatgggcagcacaatagcatgaactggggtcttggactgacttccccaccatggtaaacaagacactagaactgggtgtcaaaggaaactttctccctttagttgctcttgtccaggcatttggctacaacagtgagagaatcaagtgctacaattcccactgtaatggtattgagaagtgatggagaaggtcaatgttgctcttgaggggctgtgttaattctcatggtagtgaattcttgctctgcttgaacgggattggctaccatacagtacaatgctataaagaatgtgcacgatctcttccacacatgctcatttgccctccgcctttctgccatgacacaaaacagcttgaaatccttgccatatgctattgctatgctcttgaccttcttagcctcgcagaactatgaggccaggtaaatttctttccttcataagttgttctttcacacaacctgttataacaagaaaaaaaaaccacattaatgcctaggctctgtatttttttttagcccattctgtcaacctatatcattttatggtcaaggaacaagtcaagtcggacacttccctgctataagtgatgggtttcatccatttaaacagacctacttcactgtggatgaatgagcagtgttaggggacagtggaatagaggggaaagcatctggctgatggctaaatcatttgagttccaactttgaaggggccactcagtcactatagttttgaacaaactagttcttgagtctctgtttcttcctgggtaaaatacaaacagtcctcaaaattttcacccttcagtattttctctcctgagtcatctatttccccatgagtttgtctactaccaaatacaccaaggataattcatttcctaattttatcaactgaaaacaatgactggttagcaaacaataatgactaccatagccggaaagatgctgcagtaagcccgtgctgctggctgacttatcctaggtcaacctagaactttgttaagagtttctcttgaagaaaatactcagactttctcctccccttgagttacccctgaatacttctaccagtctcagttaaagtggctgtagtaggtggtccttaagctccaatcatcccccatgggtgccccatctgatccctgcttcccttgcctgccatgttttccttgctgcctcctaacctggttcctcagtttctgctgtgctgccgtagctgacttctaagctgttgcttatctttagaccttttctatgttctttctgcagtaataggaaacttactgaagtgtggacagtaatccagaagcctcttaaaggcagtcaagagggaccggggctgatgctctttgtggttggttcaaggtccagctctaatgcctttcagttttattgtcatagttcaggttgttaagggaggacatgcttcctataggttccgagcttacccaaaacaacatggtctcctgagcgatagtctctcctgagatttagagacacagaaaacaaaggaaaaaatgaagtgcattttggatttgaaagtggaaactcagggtgagatggcagtttaaagagtaagcatgtttgacttgagaactcactcactcttccaggctggacgaggatgccatggactcacacagttagttcccagtcagaaatggaagacctctaagcatgtacccttctcttccatcttccttattttccatctttctgccactgcactacttgctgaggctcagctgcagctagagaaagtcaagctggacggtgacaagagaactttaaaactaacctcataataaggtagagaaaccaaggcccagaagactaaggaacttggctttggccatatagaagatgagtgttaatgttcaccactagactagaaatgaaaagggagcttctaaacacacaagaagggttgggtccatggagctcaggagtgtgggatgaagcctgcgctccatctccagtgctgtgatgaataagcgaataaacaagtaaataaataaaacattatatccttggttcgtgtgccgaatagcatgcagaaagcaggtcacaacccacaacctggactttgctgtaccatctagaattgtttggaaggttcctcatgctatcactcaaagtatctttccgaaacagaaatgctacctccgagtaactgttttgcaacttgaaatctgtttgtatttaattttccaaaaataaaactcaacactaggtaaggtcctatgggaaaggggctcatggcaggccctaagggaggtagctcagggatgacaattaagaacgcccccaaccacgggctttggaagctacacagtttataaaacaggccagtttacctgcattattcttgattctttcccgatgttctacatatgctctcatccacactccatggcatggaaatctgacttcgtggctccccatcccaggaaccccctcacgaatctccacagacttggtaagattagatccaagcacaccactcaagttcccaggtgactaacccagcttcagtttttttctacccaatcctaccaaagccaccaacatgtactgcatttacatggtatacagttcacattccgcacttccaagccattgtctgtgttgttcaatctggaatacctttccacttttatggcaattgttaatgaccattttaaggaattgttaaaaatgttttccctagcagttagactgccagcagcaattgtagatttcaacttctctacatcttcaacaatacttgtcactgttttctttagttgctatcctagtgaatgtgaagtgttaccaccttttttaatttgcaaattcttaatgatgtaggcatttatgtattttctttgagaaaatgtctattcaaagtatttgagtagtattggtgttggttcttttttgaagttctggtgaaaaaaaaaaatctgccctaaagccctctggttttgtggttgttttgtttctcttaattaagagacttttttttttttttactgtttcaatatcattgctggttatggatgtgtttaaataatttattttttcttgttttaattctggtatatcttataaatctgcaaatgtatccatttcttttaaatttttccaatttagtggaataaagggtttaaaaatatgtcctcatgattttccgaatttcattagtatctattgtgacatttcctttcttgccgaattttattaatgttgaccatcattttcttttgattagcttggcaaagaaattgtcagtcttgtttatattttcaaagagccaactttttgtgtcatcagttcttatgttgtttccgtttgcccctgtttcattcatttctgtcctggttttgatgatgtcttcccgtctactgctcttggggttgtttagctcttgttttgccaccattacctattcgttttgacgtacacaataaactttcctcttagcactgccttcgctgtgccccttcgatttttagttttgatatattgcttgctccttttcattcaattctaggatctttttaaatatccttgatttctttagtaatccactcattctggagtgtgctctttagtctccaggcatctgcatactttctgtggtttctattgctgttgatatttagctttattccattgtggtcagatacaatagagggagttattttacttttcctgcatttgttgagagttgccttgtgcgcactcaattttggagaaagatcatgggctattgagaagaattgcattctttaatgtttgagtgaaatattctgtagataactgttgggtccgtctgatttttctatgttattttataaaattatcttttagtttttttcctctcatacagtacatcctgaccacagttttcctccctcccctcttccccaagatccactttccctccatcgtccttcagaaaagaacaggcctccaggggacgacaattaaacacaacaaaacaaaatacaacaagacaaggcaaaatccctcacactaaaactggaccagataaccaacaaggagggaaggcattccaagagcagacaaacagtttctccaaaaagagttccataaaatcaccaagctaacagcatacacacacacacacacacacacacacacacacacacacacacacacacgcacgcatgcagaagacctgatgcagacccatgtacaccctgtgcttaccagttgtggtggcttacactggtaggatttctgaagtatgtggtatgtggaggcaggaggatcatgagtttgaggccagcctgggttgcacataagcctatttgatttacggtattgttttgtttttttccgaatatttgtctgcccagttttagtttggatgacctgcctattggcaaagtggaatattgcagttacccactatcactgtgttggggttaatctatgattttagatctaatcatgtttcttttttgaaattgagtacacctatgtttagtgggtaaatgttttgaactgtaaagtcttggtggatttttttcctttaatgagtatgcagtatccttacttatcttttctggttagttttggttcaaagtctattttgtcagatattaaaatagctatacctgcttgattcttttctatccctttatcttaaggtggtgtctgtacttaatggtaacatgtgtttctttctgagaggtaacaaaaagaaatagattctgtttcctaattgacttttttagtctatatccttttattggaaaattgagaacattaatatggagagttattattgaacaatgtttattaatttgtgttatttgctttgttgcagtgttgtttccttagacttcttttggttaactgttctgggattatttttttctttatgtccccttgggtgtggttaatcttcctttcagactgaagtattcctctgttatgctctgcagagctgaactgacaggcagatagggtttaggtattgttcttttctacgggactggtaatgctgttttatttgtttagcctcctactgtctgcactaacattcactatgcaaatagcagcacacccccttgctggccttatcctacatcaccttctccacacctgattgcactgctttgaatcaactctggtcaactggacgggagatcttcaggaatccacgtggacaactgaacagtaatgaggttgagaggagaaggacaacgctggcatcattggaaagtgagaccccagaggagccaggaggcctccagctgcccagggagtaagatacagaggcgttgcagcttagagggtgaggctgagcagcacctacctggcagaactagaaaatgagagcacagaggagcaaggagttgctgtgcagcctgtggggcgaaatagagcaaggccagtgtggtaacacgaggaatcaggatcttggaggagctagccagcctatgagtaaaaaaagagtagggcttattggtggtacatggaaaagagattccaggggacctatgtgatgggatgggttctttgtttttgagacagtctctccctgtagcccattctgaaactccctagttagcacagactgatctagaattcatagcagcgctcctcctaccttggcctcccaatttcagtcactgcaggtggacattactacacttgggtccagtttctgctttatctctcttgtggactaacggcagacttgatctctattttcttaaatctgttaaggtatactttatgtcccagaatgtggttgactttgattcagaatcagtgtttctgggctccagctatgggtgaagaatcagcagctcttcaggagccttctaggggagttttggcaccaaatcgggactgtggaggcccagttgcatgaactatgtgactagtgggctgttggcttctctggtgtgaaacagtccctgtggaactccttcaactgctgagaccccagcagccaggaccaaggagccaccagtcctcagcttctcaggtgtgctgcagctgttggcactattttaacttaagttaatagcatacacacacacacacacacaattatattcatcatgtcatctctgttcctctagagaaccccaactaatgcagagagaagctcaacgtaattttatttcctgtgattactgttagtttgtatttcatttcgtgtaaactgctcctttcactaacctattcattgattgtgctattttatttgtgtgtggttttcaagtgtttttttttagttatttgtatgttctaaatattaatcttttgtcagatacatagtttttcccattttatggactatctctgtaaatactttctgttgctaagtggaacctttttaatttcataaggtctcatttattaaatgttagcattgtttcagagtagagcattatttagaaagtctttacctatgcctatatcttgcgatgttttccactaatgaaatttccatttcaaaacttacattatggcctttgatccatttgaagttgttttgtgcagtgggcaataggagaactggtttcactcttctacatgtgagatatccagttttcctggaaccatttgtttaagagattgtcctttgtccaatgtatatttttggctatggctgtgtaggcttatatctgtgtcttctgttctattatattaatctacatgtctgttttctgccaggatctgggctgtttttgttactttgcatttgtaatgtaacttaaaatcagatatggcaatacctcaagtgttaatgctttctgctcagcatttccttgcctgaccaaggtctcttgtattttcacatgaattttatttttttctatttatgtatagaatatcactggaatttttatgagcattacactgaatattcagactggtttgggtagtacaatcatttttacaatattaattcttccaatctacaagcattggaaattttccattttctactgtcttcagcgtcttatgatttttactctataaatctttcacttccttatctaggtttatttcaatatatttttaaggcaattgtgaatggaattgtttccctgattccttctctggatgttactggtgtatagggaaactagtgggttttgtatgtttattttgtatcctgccactttactaataatgcttatcagatctaagaactttctggtggagtcattagggtcttttatccagagattcatatcacctgaaaataatagctttttaacttctttttcatttatctttttctaacatgagtaccatgtttccatcatttccactcctccaaggctcccaactctctctcaaattcatgaactctcacttattattgttatgcagagagacagacagaagacagacgtatagatgaaaagatagacaggtttttttgccagtacatgggatatttttgttactaaagctctgtagtataacttgaaatcaggtgcatctctcatcatactttctgtggaggtatatatacatacaaccagctgtggttaatgttgctcgtatgtacgtgagtttggagccaaccatttgggattggacaacctataaggttctatgcaagttgtcaacagataaaatcaatcaacagtcctactcggctagctgtaaaacctactaatcacaataaccagcctggtaagatgatatctaaggctgcagcagtggcacttttgtcttgggtgtaaccaacagctgtctaataggacttaaggcccactaaataagaaataattcatgcctggtacagtaaacttagccaatggctaagtgaggttattggccttagaggaagaactactactgccactttcctaaatcagtgcaatttctaagtattctaaatacttatcattatacccacatataagtgtattattcatcaaaaaagtttcttcttaaagatgatagagactaatgcagaaacctacaactgtcaaaatgcagaaaaacaactgactgtgttgtacccagatgcaattgatatatctaaaaaacaacccctatacctaagaaggctcaggggatattgtagattgtaagatccagaagaccaggatgtctgctgagaaatagtgtcttctatgtatgacagggaaactgtcccccaaaaatatcaacactatagtcaccaaaacaagacttacaccatggcaatgccagatgacattccaacataaatgggaaaaatctcataaggtcccacctctagaaaaagaactattttgatttctttctttcctacttgtatgccttttatttctttctcttgtgctagtacttaagataagactgaagcataatattgactaagagtaatgaaagtgagttgccttgtcttgctcacaattttaatggacatgttttgagtttttacttatttagcatactattagctacacacttttcatatatggcctttattattatatcaagacttgttacttctagtcctaatcttctcaaggatttttactgtgcagggacattggctttgtcaaaaagccttttctgtatctattgatatgattaattataatttcagtccttgagtccatatatgtgatatactacattaattgactggtgtatgttgaaccatccctgcatctctggaatgaagataacttgatgataatgaatgatcttttggctgtgttcttgaatttggtttgtaattatcattacgaatattcgcgtgtaagccggggcagtggtagcgcatgcctttaatcccagcactcaggaggcagaggcaggcggatttctgagtttgaggccagcctggtctacagagtgacttccaggacagccagagctacatagagaaaccctgtctcgaagggaaaaaaaataatgatcgcatctatgatcatcaagaatattggtctgtgaccttccactttattagatctttatctgattttgatatcagttaagagtcgctttgccaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaacttctaaacctgataaacagcttcagtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctatatgataaaaacttcaaatctctgaagaaagaaattaaagaagatctcagaagatggaaagatctctcatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaatcctaggatagcaaaaactcttctcaaggataaaagaacctctggtggaatcaccatgcctgacctaaagctgtactacagagcaattgtgataaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgcatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaactgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcatggatgtggagaaagaggaacacccctccattgttggtgggattgcaggcttgtacaaccactctggaaatcagtctggcggttcctcaggaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatatactcactgataagtggatattagcccaaaacctaggatacccaagatataagatacaatttcctaaacacatgaaactcaagaaaaatgaagactgaagtgtggacactatgcccctccttagaagtgggagcaaaacacccttggaaggagttacagagacaaagtttggagctgagatgaaaggatggtccatgtagagacttccatatccagggatccaccccataatcagcatccaaacgctgacaccattgcatacactagcaagattttatcgaaaggacccagatgtagctgtctcttgtgagactatgccggggactagcaaacacagaagcggatgctcacagtcagctaatggatggatcacagggctcccaatggaggagctagagaaagtagccaaggagctaaaggaatctacaaccctataggcggaacaacattatgaactaaccagtaccccggagctcttgactctagctgcatatgtatcaaaagatggcctagtcggccatcactggaaagagaggcccattggacttgcaaactttacatgccccagtacaggggaacgccagggccaaaaagggggagtgggtgggtagggtattgggggtgggtgggtatgggggacttttggtatagcattggaaatgtaaatgagctaaatacctaataaaaaatggaaaaaaaaaagagtcgctttgcagtttgtcttcgctgattggtgagacttcgagcagtagttaggatgctgcgtggaagccgaagctgcacttcccaggtgactcctccggccagccgaagctgcacttcccaggtgactcctctggccagccaggcccctcagatgagggctgctcccctaagagcacctgcagctcagcctccagcagcagctgcaccatctgcagttggctcacctgccgctgcgccccagatggcccagatggctaccaccgcagccggtgtggctgtgggctctgcagtggggcacaccctgggtcacaccatcactggaggcttcagcggaggtggtagtgctgagcccgcaaagcccgacatcacttaccaggagcctcagggagcccagctgcagaaccagcagtcttttggaccttgctctctagagatcaagcagtttctggagtgtgctcagaaccagagcgatgtcaagctctgtgagggcttcaaagaggtgctgcggcagtgcaggattgcaaatggtttaatctaatcaagaaattcaagctgaagagatgtaacattggttctgtataattgatagtacaagtgtggacccttatatttctaacagttccgttgctttagaatggccatgaaagagatctaactatggatgcttactgaggcttgtatgtagtgttggttactgggcaagtgtttggcctccttggactgtgttgtgattgtgagttaaaaaaataaattggttattctgaaaaaataaagagagagtcgctttgcaaaaaaagtttgacagcattcattccatttctattttatggaatagtttgaggagttattgatggtggtggtggtgctcctcctcctcctcctcctcctcctcctcctcctcctcctcctcctcctcctcctcctcctcctctttctccttctcctccttcattcttcaagacagagtctcactgtgtagccctagatgtcctggaacttgctctatagaccaggttgccctccaactcagaaaacttcctgcctctgcctcccaagtgctgggtttaactacttggcctggtgatagttcttttaagggtcttgtgaaacttagcagagaattgatctaggattgaacttttttttttaacttggtagattatttgattattacttcattcttttttttataaagtctgttttagttgtttatctcatcttagttcaattatagcagctaaaaattcattctctttagatcttctaatttggtgcaatttaaatcttaaatgtatatactaatgtttttctgggtttcgtttgtatcttctctaactgctctccttttcatctgtaattatatttgtttgggtcatcatctcttcctttttaaatattctttattctttcaccattcctgtgtgcatataatgtattttaatcctatttgctctccattcccctcttttatcctccttccacctcctctggatcccttcttcttctcaacacatctctcgcctacttttatgtctttttacaaatgtatttaatctatctagaaggcagtttgaagacagtaggttcttcagacctatggcttccccagccatgcacttttgacaaggcctacagtaccagtcatgagtttatttcagtgaagtgggccttaaatccaatcagaaagtggatggaggggcagcaagatgggtcagcaggtgaaggtgcctgataactaaattcagtctttagagtctacataaaaagatagcatagcatatgtctgtaatcccagaactcttatggcaagatgagagacagagataagaaataagagttaagagaagtgcctgaaaccttaaggactacctagcctggagtaacacagaagaacaaaaacagcaagagagcccaatgtggaaggaaagaaccacccttaaaacttgtctcttgacctccatattagcaacacattacacacaagcacacacactcgtaaataataacaataataataataataataataataataataataataataataaagtggctggttaccctcataccattcatgccagtattgtaccagtgggttcatcttacctgatgggttggtattatagtacctaaggcccactactggctaagaccactgataaattttcttctccagtggcctacctagcaccttctggcaacttataaaagccagccagcaggaagaatttcctgacaagttttacctttatttctctaatgtccctctttcttttagttagtttgactaaggatttgtcagcaattctttgttacactaattgtagacaaacactctacttccagctgagccacatgcccgggtgtgtatcctgctttaatccaatctgatagtcggtgacttatagattggggcattgacattaatattcaggattaccattttaaaagtgtgtaataattattgttattttggtgaatttgctgtgcctgatgttttcctatttttcttttttaaaactactgttctagcaacatctattctttctcgcagactcatggatacacttatgtttcttgtcagtctaaattccttcaggtatcttccgtagaagtggcttagtggtcctgaatttctttagcttgtttgtgttatgattggttgtttcacctccaattaagacagttttgctgggcatagtattctgggttgccccgaatgaagaagccagagaaagtacccaaggagtaaaaggggtctgtaaccctataggtggaacaacaatatgaactaaccagtacccccagagctcatgtctttagctgcatatgtagcagaagatggcctattcggccatcattgggaagagaggccccttggtcttgcaaactttatatgccccagtacaggggaacgccagggccaagaagtaggagtgggtgagtaggggagcaggatgggggagggtataggggactttggggatagcatttgaaatgtaaatgaagaaaatatctaataaaaaaggggggaaaagaaagttgtcttttgaaaattaaagcacatcatttcaaacattactgcatttgaaagtccctattgaaaactactgttgttctgatgggctgccctttatgtgacttggtatttctctcttgttttcaacacggtttttgttgctgttctacatatttagtatgttgattatagtatcacatggggcatttcctttctggccttatctatttgttctaaatttctcctgtctggggacatgcatttctttctctagattttggaaattttctgctctgattttgttgaaaatgctttgtatattattggaatgaaattcttctatgctcataatgtatagggtttttaaaaaataatgtcccaatgtatcttgaatgatctatatgtattttcttagtaatttgtcattttcattgtttgaatgttttaattcctttaccttgacttttctctgatagtttgtcttttcccaatattttagctagctttatcttcactacttttctttcttgttgaatttttctttcatatgctatactgattgtcttattttgtccacctatattatttcaatatgaaattcatccagaagtgtgtgtcctcttttatttcttcaaccatatttatgagtatcttgaattctttatctgcgatttaatctagtttgctcttattgaaggtcattatggtggtattattttctggaagagttatgctaccctgggatgtagtaagtttgaagtgccacttttctctggaagattaatgttctagtgaggcaccaggttccaagcccaccacaccgctgatagtaaaatactgtttgcctgctgtgacctgcgtggcttctggattgacctaactggggcaacagggaataaagaaataacagacacacatgcagaaaagctgggttgggttgggccatgcattctgatggagatgcaccagagcatggaaagtggttccatgttgtatatacagctgagtgaagaggcaggttatctatctcagtaggaggtctctgtagtggcacagtttcaggcttcaggagtccaggaggtggaagctgtagttaacacattctgtacacacagtcagcatctgtactcagaccaggggaacacctggccattcctatgagtctgaggcgctggagttcttgacatggctcatccacacaagaatacattagctctcccatatttctctcattttatttcttatatgatcttaatgcagcttgacttctagtcctgctcagttttgtgtagtccctggaacccaagtgagatgagaaggagacaaaacactgtacctctggtctgagttattaggatcatcccactcaaaaattgagaaaactcaaaaattagtaaggttctacacacacacacacatttcccatcccctgtcaagtgtctctctcaggactgcttgtaacatactggttgctagggtgaggtctctacgttttcgagaagtcttaagttataagtcctgcattgctgaaacttaggcatcaccacgtggactcgcctcagattctgtagtagccccagaatcctctgagtcccacctaaggttgataggcattgtgagggaagctgggctcacaggggagtctgaaagagcctggattcccctcagatgaagttatgctcctaaatgctagtctttcttatctctcaggcaggggtttgaagtactgagccctgtaacttggttctgaagcagaggaagttcacttttttatgaatatgacatggatcaaggcaatctcagatcattgaccacaagccaaaagtaaaaatagacatcgtttctgggccttctgccatgtactggcttctcaatttctccaaccttatcctaggtacttagacttaccatcctctctttaggaaatcatggacaagtctcttgtatgaagaagtctaggagctgaataagctggtacattttagccttattgtccagagttttaagtatgacctttggagtcatatatacaaatccactcctctagactctaattaccccatgtttgataccagtaaacaaaaatgcaattcccttaccttcatttgtgtgcttcctatgggagcctgaccaatgtaatttccctgtcatcaggtgccacttgccctgacctccacagccttgagattggcctgactggggcagcatggaatgaagaaggagcagatgtctatacagagaagctgagcttgggagggccatgcactacaatggaaatgcatgagcagcctgaaggtgcttctgctctagaaaatgttgcttactaaaagtcttaagtatgggctggagagatggctcagtggttaagagcaatgactgctcttccagaggaactgagttcaattcccagcaaccacacggtggctcacaaccatctgtaatctgatctgatgcactcttctggtgtgtctgaagacagtgacaatgtcattcacatatgtaaaataaagaaatctttttttaaaaaagagaaactctttttttttccattttttattaggtatttagctcatttacattttcaatgctatcccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttcaaaaagagaaactcttaagtacatgtgtgaggctttctgatttaatccatggctcccagtttgctgctgatcctccatctccatgtgagtggggagctcactaataaactgagctgactccaccagcatggactttaaaccttctctctaactttgtattgttgccaattttacttgactattactaaagatatttctatgttgtctacactgtctgacaactattaccaaaatttccctgtctactccctggagtttctagaagactgtgtattagtcaccatcttagaccaccatggtgtttcttgcttaccacatgctttctaatgctttgctgtaagacagatactcagtaagaattctgttttcttggagcatcagttcctttaacattagatagtgccctccatgatgtctaataaattttcctgatctgaagacaaatctcgaaatttttaaatttttagttaaaacatagtagtcatatatatttatgtgacacactgtgttatttccatacatatatactgttgtgtttattaaaaagataaagagaagggagatatgttctatggaggtgtggtgaggtatgggagaagggggtgcctcagcgggcccataccaaggcattccttacccctgagagaccagccacacgatggtataatatagaatagagtttattcagggcatggggaggggaattagtagggtagtggaggcagagaaaggcagagagagtagagaagtagaagagtagagtagaggctgtctatgagcatgtggagagagggggaagagaatagggagagagggggaaggggaagcagagaaagagcaagagaggaagagaggagcaaaagatagaggaggggacaaccagccccttttatagtgggccaggcatacctagctgttgccaggtaacaggcatagagcatacctgtcttttgccaggtaactgtggggtggagcttagacagaatcctaacatatacaatacgtaatgatcagatcagagtgcttggcataacttttttcaggtatgtattaactccttgtgttagcaacattcaaaaatgctctactattttgagatagccatttaattgttaaccatccttattctatcacatacatttagacattattctttgtatccaactgcgttcctgtatcctctaaggatcctgttttccaccactactgacacctttttcaagtgctgataattccactctattatctacatcattgagatcaacctttggctcccaaatgtaagaatgtgtagtgtttgtctttcctttatgtcaaattgcacttaacataatgccctcccatttacccatgttactgaaaatgacataattttgttctttgtagaactatataatctattgcatgctcacgtgcacgtgagtgtgtgtgtgtcctcgtttatgtctctgttgttgtgataaacactaaccaaaagcaagttggggaagaaaggctttatttggcgtacatgtcctgatcagttaagcactgaagagagtcagagcaggaactccagcaagagcagggatagaaatcatgaagaagtgctgcttactgacttgctctccatggcttgctcagcttgcctttttaaacaacccaggtcctctccctgcatagacctagagatttcccttctgttttgcagtgctgagtattaaagccaaggccacacacaagatagacaattgctcacttagacacacccccaacccttttgtaaatttttattttgcttgagacaaagtgtcatgtctaggatagtccagcttacacgccttatgcctcagtccttcagagtagctggaatttcaggtttgtatcactaaacagcactcacacttgaggtccctgacctatgtggtttcttttctctgaagaacttcaattgtctaacatttgtactggcaacaaatgtcttccatttgttttttgtctaagacaatccaaactccatccttttcttgtttgtgaagaatggtaccttgtgaataaaaagttctagattgataaggtttttcttttgatgtcttaaatatttcaccatactctcttctcgtttccatggataaacaaagaaaaggcaggcataactcttacctttgctgtttgtacatgttatgtggtttcttgctttgccttaaacattttccccatattttttattttctctagtttgaatacatgcctaaatgaaatgatgtgtgttgaatctgcttgatgttttcttgaattgcctgcttctattgtttgatgtcagacagtaacttgagaaagttctcaggtatcattggtgcagattttttctattcctttctctttttcttctttgtgtctattacctattatgcctttaatagctggcccactgttctaggtcatttctcttcatctttcacatttttaatctttaagttagcatgcaagctattaaataccattatggcatttccaacaaaatgtatttccatatattctcctcacctcttcatctcctacactcccatgtccccatttatccccctttcttaagacaacatcttactatgtagtcctggcttgcctggaactgacagacctctacttttcaaaatgctgggattaaaagcaggccaccacaatatgtctccatccccttttgtagcctcctccaacagtctcttcctctttcatgccacatgtgtccttatgggcccccctctgcccttcctcagcacctaattttaccctcaacagatgaatatgttgaggtttggtctttagctgtgtattgtaacattcagtgcacacacacacacacacacacacacatacacatgacctggttgtcccagacatgctctgtgaccttgcccccaagttatttctgattgacaaataaagatgcagacagctaatagttaggcagaagagacataggtggggttaggattcccagacttgggggttggaggagaaccatgaggggagaagaaggtgaaggagaaaggagaagccgtcatgggttaggagaatcatgaaatcgtggccctgagggctggtcaattagagttaagagcagcccagatgaaacatatcaagtaataacttggggttatagataaaaaagtaaattctaatgacataaagggtagatatcagcccagatcttgtgctgtttaaggcttattgtaaatataagggttgtgtatgtcttttatccaggaactgagaaatcaaggtcaggtaaaatccccaaattgggattaaaattttttgacaacatgaatagataacaaaaatgtgtcacttaattataataggattttattcagctgtacattaaaaaattataagttgcaggtaaatgagtggatctggaaagtatattattgtgggagatgactcaaactcagaaagataaaactgcatgacctccctcacctgtgaattctagcctgtaatgtgtgtgtgtgtgtgtgtgtgtgtgtgtgtgtgtgtgtgtgtgtgtgtgtataatgaatgttatatgaaaagttaaaatagttcctcatggaggtgggctggaaggatgtctcagctaataaagtgcctgctgcgaaagcacaaggaaggacccaagttcagatccccagcatcaacacaaaagcctggcatgatggtagacctagaagggtagagggtgcaatgcagatgatatatccctggagcctgctagctagccagtctagccaaatagtaagctttagattcagtgagatacctgtcttaacacaaacaagcaaaacaaaacaaaacaaacaaataaaaacaaagtagaaaaaagaggaaaacacacagtaagattagtaatccctattaggtcgttatattgaaagtggaggatggagatatactttggcttctgacctccacatatacacatgcatgcatacatgcccacggacacatgaacatagcttctttggcaattctttcttaaagaagcccatatccattctctcatatgtctttcttcttgaatgcatttttttcaactctcttaacactcatgtctaagctttcactaaacagcagttcaacttcaaaatctgagccagggttggtagcatacactcagcactgaagcagacagattgctgcaagttcaaagccaacccaggcaaagttacacagcaagatcctatatttaaaaagaaacagtgagagggtgtggattggttgattgtgatctcttgaatgtaggcaagccttgttaagaacaaaatcctccagtctagtttatttcagagtggttaatacttctgatggaaatacgaggttatttttcttcagtcttcactatgagaaactggtagatctctgagcttacaaaaccatgggactcctcctatgattagcagtcccttggagattttaattctctgatcatgtgttgtgaacttccagcaatttgtcagttatagcttgggatttcctatggcactgttggttctcagagtgctctctcccctggtagtgtgctcctcctgtatattagcttgtccatttatataatagcttggtttaccttgaagactcatttctctgttggctgttggtcctatgaacagttgttaatggttcagctttgtttacattttttgttgcttgttaggacagtgtgatcacttccaacatccatagcatgccagtttggggtttgttgttgttgttgttgttcgtgtttggtttggtttgtttcccccccccccccaaacattactggggattgattcaagagccttgcatatgctaggccagcagtctaccactaaagtacatctctggcctctctcttttttcttttccttttcttttattatttctaattgctgccacttttctctttgttgttgaattttaagaagttttttattattgctttggtgtggtttttttcaataaacagtcttgctatgaaatttggactggcatcaaggtcactgcttctgagcttttccatatctttagtgctaggattccagctagttctgtatatagaatgtttatttaacttacgacaaatattttgtctcatgctgtgcattgttctttcactttctgacagcttttattttacgtgcgtgtgtgtgtgtgtgtgtgtgtgtgtgtgtgtgtgtgtgtgtgtacacgtgtccacacaggtaccaaagaggctagatgatggcatcagatcctctggaactggagttacaggaagttgtaaactgcctgatgtaggtattgggcaccaaactttggtcctctgcaaaagcagcatgcatttttaactggttggcaacttttaaagcataaaaagaagtaggtttgtttcatggtggtaagataatgcatagtgtaacatttgtaatttcagccattttactaacaatttccatgtgtgtgcacattccagtgcatgtgtgtgtaggtcagagaacaagaggacaattcggagaagttgcttctctttttctatcatacacgtcctaggaattgagttcatgtcttcagacttgatggctgcctcgatgttgcatggcttgatcacgcatcctgaccaggggtgctgaggaaatgaaaaaaggacagggacacacagaggcagaagggctggcattgggtgctctaggctctcagatggagaaagtgcagctccacagaagctcagcacgtatgcaatagaacacgaaggcgagcctattgcttacagatgaacaaggagatggggtttgtggcatacaactgaatcaaagatgaagcttcagctaatctcagtaggagcagtctctgtaagggggcagtactcagtccataaacacccaggagggaagctacaataggcattttctgtacagcctatcagcattcacacttgggtctgaggaagtcttcgccattcctcccagcctctcacccagagaaagcttggctactttcattagactgtggtgttggggtctttgacttctctggctccctacaggtggccactgagccatcttgccaatcctattttttgtcatttcaagttgcattcaattcgcttgcattattgtgcaaccctcacctttaatctatgtctagaacttcttcatctgcccaaactaaaactctgtacccattaaacaatagctgtctacttcctcttcctttcgactcatgactgtcaccatttttaaatgagttcttaattgtgtttcattggtcaatatgtacatatttatgcaattaccacactgtcttggtggctgtaacttggtgatgaatatgaaatcaggaactgtgaatcttacattgtttttctctttaaaaaatgctttgtctattctagttctcttgccttttcatttaaaatttggatcaatttctgaaaagaaaattcagtaaacattttgataaaagtattgattaaagtaagagtactatgatactctgtagtaaattgacaacttatcttaccaatagtaagccttatccatgatgtaaagatggtcttatttatttatgttttaatttctcccagcaatatattgtagtttacagtgtatcagagttgtttgtgtttgtttttgagacaggatctcactctatagcttaggtggcctggaactcctataagtgaaccgtaatttgtacattatgatacaattataaatagaaataatttcttagttttattttaagaatgtttattgctagtatataaaacataaattgatctttgtatattgatattatttgtaaacatcctgaatgaattgattagttctaacagttttttgtcaagtccttaagattttctacatatgagaccacttctacctcatctgcaaacagaagtagttttatttattcctttctaacctggatttttttattggactgtcttgaacttcaagtataatattgaattgatatgataatagtagatatcactgtcatttttctcatgcaaaagagaaagcaaccaatctctcaccaagaattatgatcttagtgttgagatattattattattattattattattattattattattattattattattattgtgcgtgtgtgtgtgtgtgtgtgtgtgtgtgtgtgtgtgtgtgtgtgtgtgcaggcaaaagcctgacatgtcatatgtgataaaggttagaagacaactttctgaagtcagtacctgctttccactttattgagtcaaaatcttgcttctcatctctaccaagcagcccactctaggctagttagcctatccacgtctaggaaacttcccgttttcaccttctatctttccaggggtgtgctagtgctataggtgcatactactgcatcaaacatttgcacatgtgatctgaggaaaaaactcaggtggccagcttgcatggaaaatgcttttacccactgagacacctcaccagcccagccttggattttggagggagggggcaccattttgggatttttttttgtttgtttttaccttattttgttttgttttgttgcttttttcaaggtcaggattctctgtgtgtagccctgactgccctggaactagctatgtagaccaggctggtcttaaacacacaaggatctgtctgcctcctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgccgctgcctctgcctctgccgctgcctctgcctctgccttccaagtgctgcgattaaagacgtgggccaccaccaccccaggctcagccttgatttttatatatggctttttaccttattgaagaaattctcttctattcctaatttgtagtgtttttctttaaaaaaaaaaaactatgttttgctaatttttatacctctcaacattatattactttatttccagacattgagtcagtattgtattgctaggaaagatccataaggtgatgtgtataaactttttacatatgtaaccagattcagtgtgttagggtttgttgtgttttgcatcaatacccagaagagataatagtctgtgtttttctttccttgttatatctttcacaggtttggaaaagtttatgaaaactggtattaataattcttttattattttatgaaagtcaccagtgaggtgaggcttaagaatgggcaatagagtatttaattaatagcattccagctctcattatggttctattcagattctctgtgtcttgcatgaattttggtcatttatggctttttagaaatctccccatttcatctaagtaatctaatttagtggcatacaattgttcataacttttctttaagtttcttttgtttctggaaggccaatatctatctcttctctttattcttaattttattaacttgtgtcttctcttattttcttggtaggtctcattaagttttctcattttgtatgaagagcttttcaaagaattaatttgtggttttgttgattttttcccattgttttattcttttatttatttctgttctactcttttgtgttggcttccttctgtttggtttattctgctctttaatttttatttttctaggcctttgaggtgggaatttatattgctgatttcagtttacaagtttgtatgctagcatctcactatgtagcatgagccactccctcgaactaacagtgtagtccagactgtcctcaagatcatggtcatggcatgccattgtcatcatacaccctgtctcagctttcaaagtactgaaattataggcatggactgctatactcaagtttacatttttatgcctataaaatttccagaccaagtaattcatttactaaagtatgtgattgaacgtttttaatatgtttgtaatgcgacagaatgcttaccactatctacttccccaggccacagtgactggtaatctacgttgtgtctctatgtatttgcttactagggacattccatatataagattaggtgctgacagttttctttgcataggtcatcccaccacctttagcctctattacttcttaatcatgatgaatcatttccttttgcttttttgtctcagatgttatttatttatttatttatttatccattggctctcatcactttgtggtatttctaccatgacccttccggtgtccactcaacttctcatgtatacaactttttagctatgtagattactgtctgtctttaaattttgaggcatctttactatttattttctcctctccatctccctcttctttccagaattccattggatgtacatgtctgctcacagtgccccacattgctctgagctctgcccactttcctggctgacggtttgctgagttttctcctgctgcctcaaatgcactcttttttgtttcagctattgtagtatttagtataaatttcttattggttgtttttatacttcgcatttctttatttttctttattagtggtctatttggtagtggtctatttctctatttttctttattagtggtctatttgtcatcatacaccctgtggctctttaggcatagctttctttacagcagctgctttgtcttctgtgttgacaatctgccccctcgagacttgttgcttgcttttttcctgtttatctgccagtttcctgtttctttgcatgtctcaaaaatgttttgaaaactggatatttcaaatatcatattgttgcaactactgatattattattgactttactacaagagtacagaaacgtccacttcccttcattgtacagccttcacctagcccttcagaggtctcagtctcagccacgcatgcacctctgccaccgaacattactgggatcttagcacagttctgcctcttttcctgtgattcctttttagctcctgtataatctatctctagtgatatctcacactattagcctgcactaattgcttcataattccaccattgcatttttaacaatgccctagagtataaattattctacaatctcatccaattaaagtcagggccattacaagggcagggtttcaactgtctctgaggcttattcagaccataagaagatttttcttagcttttgctctggttctttttattaaactcatatcttgtctaagcattctgtaattgctgctagagtcatagtactcccagtcctcttaattattcaacaatgagggctggttctgataaaccccttaagcagtaaatttcgccatttttcttttagataaccattaaggctttctgggggtgttttgttttgttttgttttgttttgttttccttaccaatggcactagaggtcagtcccagagccttgaagatgttaggcaaatgctgtaccaccaagctgtatccacaactcaggaattgtctagttttaaagctggtatttccttgtggacagaacctctgctctcgtacattagatccaaaagcaggggaagccgagtgacacttgttctgtgagcaaactgctgcacaagaatagaaagccgccattttccttcacatttctctcttggcatcgaaccctctccctatggatgatgtggagtagagatgatctgaacacaatgttacctactggcctgtcagtctgcccagtagagagccctgcccttactaatatgagcttagaggaaagagaacttcctagcccatcatgtcccatccccagagagaaaaagcttatggggatgataaattccagcagtctatcccttctgggtcaaactgccaccctgtagcaagagatacaagatgaagaaacaccatgttgcttactgaccccatccaactccagaataaaacaccatggatactgaacaggggattaaggatgtatcatagctggggtgtcaattgctgtggttacaatgatgacaaaatgcaaattggggaagaaagggtgtgtttcaccttacagtttcacatcacagtccatcactgagggaagtcagagtaagaactcaaggcagaaacctggaggcaggagctgatggaggaatgctgcttactggcttgctcagcctgacttcttaggacaacacccccacagtgagctggaccctcccttgtcagtcatcaatcatcagtcaagaaattgcatcacagacttgcccacaggccaatgcagcaggggcattttctcacttgaggttcctctttcaaaattactctagtgcgtattaatggatgggagcagatgagggcacaacagactattgtaattcttacaaagatttactacagtcttgctgtaggcaattgaaatagtttccagagatcttcagtgattcctttttctgagacagggtcaaactcactatgtagataaagatgaccttaaatttcttctcatcctacctctacctctccagtgctgaaattacaagtatgcatcatcatgcttagtttatcaagtaaggaagtcaaatccaggaccttgtacatgctagaaaagccctccactaactgagctacacttccaggctcctcaagtagttgaattttagagtatacttcagcagatggatttgattctgtaggcttctcaagcttttcacctgtctaattctgcaacagaaaccccaattgtaaatttgtgaagttcatccatacacatgttttctctctatgttccacacctccagcgtagggcaagcggtcctcccctaaggaggacaataggaaaaacctagaaatagaggtagtaattgaatgctgaatcctgccatttgggtttatactgctggctcatcctgtaagactaaagacaaagtaggaagtggggaattaaaatacaacactggagaacacctcctcatattctctaactgcagtctgccctctagaaaaataactaagatagagtatggaatttacagacgagagggctatacacctctacagagagatggattggaatcactctcttaaaccacacaggaagtagccacggggacaatgacaggggccagaagaaaaagtgttgcctatgtggaggggtcacaaaggaacatcctgtcctcactgagattttttgtaaggttggggtttttgtttgcttgtttcattgggctttgtttgtttgtttgtttgttttatgtgttttgcctaaatgtgtgttcttgtgccatgtgcatgcctggtacctgcagagatcagaagagggttcagaatgccctaaaatggttgagatccatgactcggatactgggaaccaaagccaggttctctgcaagagcaacaagtgctctgaactaccaagccttctctccagcccctttcactggggttattatctaagcaaatgacagggaattatatgccaatggttgctgctattcacctggactcaagagtccaggactcttgagaacacatagaccttaaatagctccaatttcttctttgtaaggaaatctgtgcccagtccatgatggaccaatcagatcataaagacctgagggagtggcggacttactaccaattcccagaggagcagcactagcattcattagtgctctaatctgcaccttaattgccagcatctttctaggcctctgtactggtggtgcacagtcaccttcctcatctttcagtagggcttctaggcagcaaagatcttccccaaggcatctgcattccatcttctctccctccccctttcagtgagctcaggaaattgattttaatccaccaggctcccgttgcttagcaacaaaagcgcctgctcctagcaaccaggagccacaaggatgctgcagaaagagggggctgtctgggccctgctcttgctcagttatcgactgctccttctccggtggttttgttttcaagccattatatccttcctctctcacttgctgaatcttaaaaggctgaatgacctcactcaccatgagagtgccaaccaggagggcctgtgaatcaaattgcccaagacagtaagaagcaaatcatgatgacaacagattgggcctagctgtgaaaaactttctcggagagagacagaagtcagtaactgtgtggtggttcttccattgtgacgttgcaggtgggacttgaccctgtaaccctaggtgagagcatcaagaataaaaagttgagacaggaacttcaggagaaaaatcactactacagataggccagctggttttctggagcagcctaggttcacacagctaagcctgggtcagtgccacaacataggatccctgagatagttagcctccttgagactgctaggccagcagacagcccatgaggatttgtgctttctttcttaaacaataaaagaaatgattgcccacacgtgaaggggcctcctgccttatgagatggtcacagcccaggggatcacctagggagaattactacttggccaactttcccagaatctttgaaatagttaagagttcaggagcaccaggaaaggcctttccagaatttgactctgtcatgataatggatattttcccagaggtcccacatcttgacagaaacagcagctgatggctccctgaggagtggaaagggccctgatagtaactacagaaaagaaggcgcaggaacttacatcaggagactcagccatctcttcccccaggttcaactcagaggctcatgcctgcctctgagcgagtttcttcctcctctccctccattcctcccaaggaacaggctttggcctctctcgtccactgcccagcacacaaacctgcctccacagactgaggggtagcatggctgccgccagaatgagggggctgaagagaaggggcatgctagccgtctccaggcacaagctgctgcctgcacacccacagtgctgctagtgcacagggagtgacacacagagggttcctgtcacctctgtgggggttattcaccacaccaaatgccttcccaaggaggccaggtaaccacacttgggtacacaccttccttgacaactttctgtatcccacagtaaaaccggctgtcacagaaaacagcaaacctaatcacaaaaatgtaagggttcctgtacacatcgcccagccttagagatggtcagctcccagacattcatctcagcactggatccctaggaatttcaggatgcaatccagaaggacaagaactcttgtcactcagccttgctgtcatgataagacctaggatgagtgctatcctaacacatcatccgatcctgagtgtcaaatgcctgatggctcattggtgtcgtgaaatgtactagtgtgcttttttcagtgggcaacactagaagattctacatccttgcccaagcaacaccaagaaaaggttgcacaggtaggcttggtggcaaacacctttgattccaccacttgggaggcagaggcaggtagacttctgtgagatcaaagccaacatgttctaaaaggggagtctctagaagagccatggctatacagaagagagaccctccaaaaagagaggcagagagatgggtgaagaaaaagagaaagaagtgccttcctcatgctctctgatagggttccagcacagggtagtcacccatggaaaaattccacagtgcacacactcttccataagtgtgttctccagagttgactgagtgacaggaaccgctggtcctcaggctcctccggagacctgcgggagctctgccttatgctacttaaggccatgcagggtcctcagttccaagatggcgctgagagtcagagcagtgaggtgaagaggtgacagaaccctagagttggattaacttatgtcagccttaaaggaagcccttggaaagaggacaaagagggcctccaccccaatcacccctaggcctctctgggtcttccctagcagatgtcataggccagcatagttccttttcctctcacctctctcctcccaggcgtttgtccttgagtagctccccggaatgtgatgactttgggaacctgattcctgagtgactgtgtcccctcttcagtgagctaccagagacattaggaaggtgtttcccacgtggtaaaccatctgcctgtttgcctgagtgaaggtcttccttgggcgagagatgaactgcaagtataagccagtatttgaggagaaatcctagtctttatgcaagatcaaccatcagacactcagaaaaggccaggagactccatgcaacagctactagacgtcggtatcttggaaaaatgcctctggcttcctctgagagctacagcaagtcattccccatttgggaagacactgtagattcagggctctgtcctggaggtgagaggctccctcatcttggagaacagggacctgttgtagctgaagaggccaagcaacaggtcctggtctctgctcagacagtattcttctttcagtccctgcatggatcgcttcccctcccagggtctgtttccttatttttacagcgaagaggccagcaactctctagggccccatgagctttgaggtttctacaatctcagctggagagccatacacactccctggtgcataaaccatgcctaggttttaatcaccttctgtcagggaggctcttcctgcttgctccctaactgtctctgagctttgtttcctctgaccaagtcctgtgtcttgataaggataccgattgtccccaaaatgcctgcactggaaacagacatttccccagctcgaagactccctgctcttgagcccatgcttgaggagacaacagcctccaggaagcatgttggtgagtcatcatgggacaggctggccacttgccattcgcctgggagggggaaggcaggggggtagaattcaaggtcatcctcaaacacataacaagtttgtggcagcctaggatatgtgagaagctgtctcaaaatccacaacatttgaaacccacctcaggagccgagaaagagagagagagagagagagagagagagagagagagagagagagaatgcgcgcgcacgcacgcacacacacacacacacacacacacacacacacacacacacacacacacacacacggcaggggagggagggagagcaagaaacaggtcataaacatatcagatactaataccagatgccaaagctggaactgtagcctgactctggcagcttcatttattcatcagggactgtgttgctgggaagtgcacagtgagcaagaggcccttggtgggtcttcttggaacttgctgcccagctagtgaaaagcatgcaaactcagctcctcccaggctgaaggaaggcaccaggcagtgagaacccggcagagcctgtctcaggccactgagacaacaccgtgctgtggaccccatccaggatgtgtctgtcgcttgtcacgtcagttctgaactgtcaggaaattaaccttggggagcagtcagtgttccctattcaattcagacaagagaagccaaagatgtgagtggtcttcaaagactgctacaggaactgggctgcttctgggtcttggggacaagactattcccatctttgggtctgcactttttcaaggagcaggttttgccctctaagattactctcgaggcttctgtggcttttttaaagcagaagtaaaatatcttcgatcctcctcctctccctccttttttcttcctctcttctctcctctccctcctataccctcccctcccatcctctcttctcttcccttcccttcatttcccttcccttctttttcctcccctcccctcctcttctctctgtgctgctgggtacactctagggctttctatatggtagtcaactgcctcactaacaactgtactcccaacctagaagttgcttgtgacctcaatgccaccaccaccactaccaccaccacctcaccacctttagtgatatgaaatatggagttaggagcctggatacatggcagaagttcaatgaatggtttgatacttaggcccagaattttttcttcctcaaacctgtatctttgatttaggtgcccttggtcttagcaattaaaatacaagtgctcaggcccagcatctgttttgcccctccgtgggccctttacccaagtgtattacagaaagcttgtcttgcaggctctgttttcattaagccctgtgacacatggcttccagtaagccatgttttaccgaatctttcattgaaaacctcaagaactgattcctttcaactgcctgtgccattactcagcctctgagtcttttttgtcagactggtttgtaaatacttggatgttgggacattatattttctaaggataaggttttggatctgttctctccccatctacccccaatgccttactttgctgcttaccctaagaaaacaagaccctctttcatagaaagcagtggtctcactacatctccagaacttggagacctagggtttcagcttctcatatgacaagccccacctctgtagcatcttgggtgatggagaattctgagtgagcatccggcctcctctttctcattgcatgaagctgaggaccaaagaacaccagtctcttgcccttgttctaggtgctcaagagctgggaacctttattttactcagtcattagtaattaaaagccaagctcattgggataaagtccatccctaatgagccttactgaaacagttaccaacttttgtgcctttatttttgtgtgctacataccagggcagctagcacctcacccatgatgggagaagtagtcctctgagctatatctgcaatcccctaaacactgttgctgcttcaagccagactctcagtaagttgcctggaacccaagaccttcctgcctcagcagctgccacagcagctgaagctgcatccctgtgctaagaggtctgtcttaatgctgatgtaattcccatagtactctttgcattctctatttacctcttattgaagatggacattgtgagctccagagaaggaggccatctgtgccaagttacatagaaatatattgcagaaatcaagtttcttcaagaaaaaaaaatgtataaatagaaagactgaatgtcccagcttatggttcttatccagttttaattgttaaagttaaattttcctctcaaaattggcaggattttagatgataaagtatgtgtgttcctcccactcctgcaccttctacctccatcctgtgatgtgacaatttctcctgtttttttcccagtggaaaagtaaagtatgaaggagttacgttacttgcctaacgggatatggagagtggtgaagggagcctttaggtttcgtttgagcagagcttcagctctgtactcagttgccacaccattctttagtgtccccaaacccatctctcaccagagaggctaaggtaacagagtgagcagtttgcttggcctttaattgtgtcctatcagtgatagcattttcctgggcttggcatgcaatgcagagagcaagcagcccaggggagaggtcagagggattcttctcctaggcctcagagccaagagtgctttttgtggtctctgtggataatagcacaagtcagtagagtggatgagctgggaggccaggcagctatagcccttgaggaagtaggtacacgagcaagacccggtgctgctgcatgatagccacctgatactccctgatacccagccatctggcacccagctctgctctgaaacagctcagcttcgatctccaggacgcccacgtttgtcaaatggactcttcttaactagaatgtagttctggaggtaccgacatccacttctcattctgaagcgtcatttcccacccccttctgccacacacacacacacacacacacacacacacacacacacacacacattcattctcttctacagcctggtattactgactgcaaaacttcatccagaatacagtcatattctttttcttctgaacctcaaactcaaatgcatggttaatcttttatgcaagttttttttttctgaaaaagtttgttattgccctagagcctagccctttgaaagaacatggcattctattctgttcttcttcacctcagggctcattgactcactccatttcccccaccctggcccctagggaaagccacccatatggaaagcagcagcctataatgggatctaggaaggttgaccatttctagtatttgctgctccactccacccggccaggtgggcactctaggagagaatcagacctatttcctacagcatgcccactgtacgaaaggactgtggagcactcccaagcacctgaagctcggaccttggtgacttcaaaatgttccctcaaatctcgtctcccttccaaaggatgaagaaagcatttggttccaggaaacatttggggaccggttttcatgtactatctggggtgcagatgctggtttaaaaccttgctgtctttctcggcttactttctgacccctacaaccagagtcccttgtcattctcatagtgtaaggctttgtgcagtagcaaagaaatatgtccctttggcattaaaaaatgatgattttgaggagtgtgttttcaggtccttaatctcttcatgatgtatgaacctaggttgatctgaatgagctcaaaatgtcatttccaaatctcacttgcagaattcagtcatatttctgcccccatcacaggtgcttagactggggttccctcttcctagaaattgttgacaccagttttgttggtgtagtttctaatcccatctttctataaacaatgatggcttgagtttgtatccatcctcaagttttgtgtgtttaaattaaatctctcttgcaaggcagcaagaggagaaagagacaaatcagaggagacaagcatacacactccttagctcttgctatgcgatgccccgtatcaccaaaggactatgctaactagaagaccatccccagaagccaaaacaatgaggcctgcctatcatgatattttaaacctctagaactgggaagaggaaagtcaaccacagtcattagataaaatgcttttagcattccacttggaccttgtataggatatccagtgtctaaaggtctaaatactggagctcaaaagatggctcaaaggttaagatcgctgaatgctctcttccagaagatccaggtttgattctcagaacccacatggcagcccgcaactgtttctaactccagttccagaggattcaattatgtcttctggccttggtgggtaccaggcaactaagtggtaaacagactacataaaaacaaaacactcatacacataaaataaaatgaagtcaaaataaaattaaataaagatctaaatcttcaaaactgcatagtggtgcacaccttttaatcccagtactcggcagaggcaggtggatgtctatgagttcaaggccaacttggtcttcacaatgaatactaagacacccagggctgtgtagatagagcctgtctcaataatacaaaacaaaaacttaaatcttttcctaatcttgtcatccacagttgtgtgcactcagaatcctaaaatctgagaggctgagatagaatttaaatcatcttgggctacatagcaagaactcgtttcaaaaaatagcaaaaaagaaagcaaatataatgcaatatatgtgaattattgcaggcttaataaggcctatactggagcacttccgtctgaaagcttccatgaaataccctctgagttctttatgttctctctaacccccacaagaaaccttgacaatggcactggttgatccaatccagtattttccaaaccaggtggtatagatgaggtagctaagcattgtccacagtctgatatttgggatcactgacaaaactcctttcataggtacaccagcctcttgcttgcacactccataagccatggcatccctgagcctgtcaggttcttactcagtattggctcatagctttgggctaggatgggaatgtgtttacagctctgtctgggctatgacccccattctacccccaccccagaataccacagggcctctacagaaacatgcttctagcctttaaaaccctggtattctcttctgtcaattttcccaagggatataatctttcaagaatcttacccctgtgagcccatgaccttctcttcagccacctgacttgtgcagcagttccctttacccttgccaggaggactccatagatccgatttaaaagagactgagggcagactggggttcttttgtctacttccttaggccccatattgctttcattgttgctttgtgggcacatgcatagatacacaagtgaagcaagcccagacttggaagttaagaacttcgaggaatttctctgatcctggtacagcagggatcctgaagtaagctgcttgccttctttccaccttggctagtccacgtacagagtggtgcaaaacaccttaatcataatcactaaataaataaataaataaataaataaataaataagtaaataaataaataaataaatatatatataaaataaataactctgaccttgctagaataaggccaccttacatatttacatgctctggcattccaaggccatggtgaccatatgtgtgtggaacataatacccatggataggaaagcacacctttgatgatacaattgagaataagggagataaatatgaggcagggcaggaagatacaaaattaggcccactagctcttcacaaaccactcaacccacttagccttgagttcttccttttcgtaagacaaagtacttctgcagagtacacacaacacagtcaccaagagcatgaacttcactgtcaatctgagccaggttggaagcccagctctaccacttatagccatgtgcactataatggcagtagaatgttttaattatatatatatatcacaatcctccaaggagaaaagggttaattttggctcatatcgtttgtagcttcctgcccatatagctcgtccctgttaattttggacacatggagatagagatttttatagcaggtagtatgtaaaccagcaaaaccacccgctctgtggccaggagtgaaagagagaaagaagaggaagaaaggactagcctcccattgtctacttcaagaatataaacccaatgtcccgaagttctattgggtcatatctcttaggggttctaccacctcccaacagctccattctaaagaccatgcctctaacacatgagcctctgcaagttctgaggtggcacccacctgtaataacaaaacactttaatcatagcactaagaagactgaggcctgacaagtgccactttatgcctagtatgggctacatagtgagtgctaggccctcctaggctacacataccaagattcagactcataaaccaaagaaacaacaactcccaccacctccacaacactcagtggtgtaacaccaaggtagcatacagtaggtctgtgtttcatcctcagcgctgacaaaaatatatccaaattacagcatcaactgatcaagccctagtctttagcaatgtacatagcactcaccagctcccttatgaagttgttggaataattacatgagacagcacagctgacaggggaggaattggacagggtactgtcctcccaagtactgctaggaagaaaggagcagtgtgccgaaggagattgtctccttcttacccatgtgctgcgagagaatctcctgaaatactgtaaaatgacttcagaaggcaaaaggactgttcaaaggtgagctggagctgacattaaaagacgaaaatgtcagaaccttcccctcactaacaggtttatcttgagcctccagactccgccttactcaatgctgctgtctgtgagtattgctttccttgcctgctgctcatccatccttttggtcacttgctcctcttagcagactgaactagatgaagggatttgaactttcaccctctgccaaccctgccaccactgctgaggtgcttctcaggcaaagagccagtgctcagcctaggccacagcttctccttgtgctggccctaagaaacccaggctcctagttgtcagtggtcagacttgccactgacacacttcagtgttatgggtgtattgaaacctgtggggtgctctggggacctactgctctaagcaatcattaatcctatttcataacagctactcaacaaacctgggctagcgaatggagggttgttgcagtgggggaggggacgggttttcctttatttgctgcctcaagtgagtcatctgtttatcccaagataatatttaatttctagttgccagatctcttaatcggcacaaaacaatatttatttaattgtttacttttatgaggcccagtccccagattctgaaactgatgcagagaggtgtgaagcgaattgttcaaggtcgaacagtaagtacatgggtaccgtccttaaagccatgtctgggagtgcccctcaggggccacgtgtgtgcttagtgtagacaagaccctgggttccagctctagcactcaaagccaacaaaatgacaaaccatgcctgtctgactgcagagattgcgcatttatcactacagaaacacagaaagataaagccaaccccaaaccctccagtattggtccaaggcccagcaggctgcaggaccgctgctgtgcagcttaagaaaacatttcagttgggtaacagattggtaactactgcagtgccctctggcctggggagaatgttgattaccttcctctgctctttccctcattctctccattcccctcagaaaacactcagcttggggctggaggtatgcctcagtgcacaaagctgtaggctcagtcttcagtgccatttaaaccaggcaccatgctgcctgtgcattttggaaagcaaaatcagaggggctcagaagttaaggtcgtatttggctgcataatgatactgaggctgtatgaaaccctgtctcaaaaaaaatgtctaaagaaaacacttagccaaaagggacagtagcccttgaactcgggccatattcttcccaagtcctctgtcctctttcccttcgctccatccctcttctctaacaagaaatccaagtgtgtcagggattatctgcagaatcctgatcacaggcaagagtatacggcctaagtgaccacttgggattttctctgcactgtgatgtttcatgaaatcctaacagcagtccataaccatgctgtcaatatgaactcgtgactcggttgtgaagatcaaagtcacatcgatcctggcagccagtctttctagacagactactttgtcatctgccccaggcatgccattccaggtttcctccctaaaactacaagtgtaaagaatgctgattctggaagcaaagagatcaccatccattggggttaagagtcaactatccaaaactggctgcttcagttgattagaagtgtcctcaaaggttagggtgagacccaatccagttactgtctcagagtagacaggcttcttttattctttcttatttatagttatacctaagcattggtgcatcctgacagcagcatacatcatcagttacataacccaggacagaaaagtttgaagaaggaaagtatatttatttttcactcatgagttcagatggctcagtccatcatggcagagaagacatggtgaaagaggtcagttcacaccatagacgaccaggaaacaaaggagtatgactgcaagtggccgaggataatttgccctcaaagtgtcctgtccccagtgtcctgcatcctccaatttggccttcccacctcagtttttgaaacctccccaagtagcaccagcagctggggagcaagtatccaaaacacgagcttaggagagagcatgatctgttcaaaccacaatatagaatttagaaagttggccacctaacaatgctccattttctggtggttggaaaatgtattggaggagccacgtgttcccaaagaagctgtagagatttcctaacctggcaggaagcaggcacctagtgagctctaggcaccactgccaaactcagtgcaacagcaagcacacttatattccttctggatcatgggctcacttccttatttctctgctacaatggactctgctcagaatgagacctccaagccagcacttagaagctatgaggcagggtgctaatggggacaaaaagcagacagggaagaggaagaaagggcctgctgcaagcacactgagacctcattcctactttgcaatgaacaaagtctgtgggcctcatgtcaccatctgtaaacagcgggggatggatcatcgatcagccttggcttagtgcctgtagctgcctagtgacataaaacagggagcttggaagtgagacagtggagaccttgacatacatccaagctggcaatcactggccttaagtccaagggtaccaaggccatagagtcatcacctaactgagaagtagaaaaacagcccaaaaggcaagcaagcttgcaggaaaggcaatttaagatttacttggtgtcttaggaaaaagaagtcatggtgaatggccgggtgggtggaaagagaaaagtagacctgaagcagaggtgaggaagaaccagtgacttcccatgagcaccaggtgagagagacacggaaggaaggatgagacagaggcaaagaagatctgaggagagcactcttaccaggagcgcatcaggctctgtgctgtggggaaagaagcaacatcagactgggtgtccaaaactgaggtttctagtcctggctcagaaatggacttgctgtgtgtccttcaatagtttgtgccctctctaaccctcaatttcctcacttgtaattttgtggttttcttcaaccctttattgaggaaatattaacatacagcaaaccacacatttttttcaagagtacaatttgatgagttttgacatctgtgcaaaccagaaaactaccaccacaatcaaggtcatgggcataggcatcacccctcaattttcctcttttttttttcaataatttttcatttttacccaactctctgcacctctcctcctccacaacaatcacagaagatgatagtctttcaatgtgtatgtatttgtttgaccatttgtttattgatgagggagttccggtgggttccaggccatatgaggactttacccagttggtttgcctactaccttgttaggtaaggtctctctggtttctgctgctatgtattcaggctggctggtccacagtgctcgaggcgggttctctttcctctgctgcaatctcactggaggagttgctgggattactgagtgttgagactgcagatgtgtaccactggcatttgctaccctcagagccatctctccagtcccagccagttatgtacttttcatcacttgatgattctgtatttctaaaggtttcatagctgggatcatataatacaatatgtatcttaggcagcaattggcttcttccactgttttgatattcatctacgttctgacatttgttattagttcccctccctcatttccatgctccctctatccctatccctccctccattcctctatccttccatccctgcttcctgcctgcctgcttgcctgccatcattctgtgcttctttccagctttattttggaggagtattgaattttgttattatggaaaagtccctaaaacatgcataagatttcaaagtttcataaatagcatgtaccatatatatgctgtgtttaacaaaatgatacaaatgtatgtgtcaagatctgaaagaatgcatatcaagttaaactacttgctaccaagtgattggaattatagatatgcttcttttgctgcagtttcctaattttctaattgtcaaaattcataataggaaaatgtcatgtcttaaaaagttttacggaagcataattgacataaagtaaacagccatatctaaccacacgagatgaaaaggttttacatacataggcatatgaagccatcactataattaagatggcaagaatatacatcatctccaaagacctctccccagccactggacttctgtcacctagattagtttgattttctagaattttatataaagggaatgggaaaaaagatattttagccaggcagcagtggtgcacccatttgatcccagcactcagaaggctgaagtctccatatgttcgagaccaacctggtctacagagtgagttccaggacaaccagggctacacagagaaacctaatctcaaaagactagtatataaaacatataatttttaagtaggtatttttactctgctttctttcactaccatagatgtttggagattgccccatgatatcctgatcacattggatatcaacacttcacttttgttttctgagtagtatctcttggcatggatataccacattagaggatttttttttttactattacaagtataattatgatgaacatccacatacaaagtctgtgctttctctctctgtctcttctcttctcttctcttccttgtttttgtctctcttccttctatttttttgaaacaggctgtcattctgtttctttggggttgctatgtctatttttaagtatttgagaaactgaagcattttatatttacagcaaccatgcaggtggaactgagagttctagcacttctaaatcctcctcaacattgggagtggtcagttttgaaatgttagatgttttcatcagtatgtagtagactctttgtggggtttagtttgaatttctccagtgaccaatgataccaaacatctttcctttacttttagctgctacatatcttctctgatgaagtatgtctttgtatcttttacacaatttaatttttttatatttattttgtgtgaataaaagttttacatatatatgtatacatataagcatatatacatgtatatacacacacacatacatgcactacatatatacctggtaccctcagaagttggacaatgttagagatgacaagaaggtgttggattctccagaactgctgttgtggatagctatgagccaccatgtcagtactaggaactgaactcagttccacttcaagagcaacaagtgctcttaaccactaaaccatccctccagtccttggacatttttttaaaattcatttcccatctgtgtattttctattcctttggcttcttagtatgctagcaagagccactagctaaagtactgtaaatagaaaacaggtaccctctcattatgaagcatgatgttagatgtgggtttttcataattgactttgtcaggttggaaaagttaccttctatttcaagattgctgagagctcttctggtcttgaacagttattgaactttgtcacttgtttttttctttatctagtagcatgattacatagttttcattttaaactaagtatatagttcatcaattaatttttggatgttgaaatggctgtatttctggaataaattctacttcatgatgttttatcctttttatatattattgattctgttagcttaaatgttaaattttttaactattagattttggaagatcttgagggggaattcagacaatgcctcactctgtagcccaggctggccgtccaatcctaagcttcctaagtggaaggattacagaagtgagccaccatgccaagataccccagttttatgaagaacatttgtttatattttacttgtgatgtatttatatggatttgtcatcaggttgtctggactggtcatttggtggcccctctatgattcttaaggcttttttttttttttatctttaagattttgtagctctgggcaggcaatggtgacacatgtcttcaatcccagcacttggaaggcagaggcagggggatctctgagcttaaggtgatcctgatctacagagtgagttccaggtcaaccagggctaacagagaaaccctgtctcaagagagagagagagagagagagagagagagagagagagagagagagagatcaccaccaaaagactccgcagtcctgagaagagcccttctttccctgtttccttactgtttgtctgcctgcctgtgttctttctctttctcatacccacattcagatgaatgtttgatagccagactctatattgggtaagccagcttcctcagaggaaaattgaggaaacttcttcaactcatagttctcccagagaaggtaaacttgggtcaaataatttgtagcattgtgtcagctgtgtagtagatatctggtgattctatgaagcctgaggtacaaaagcagtataccatatgctgttaagtatatcccagttaccccagaggactgagactgggcatagcctgctatttcagacttggcatgaataggcctaaatgtgagtctctctgggtctcagtctgtaaagttaggaagtagactccttagattctttactctaaaaattgaagtagatttcagcaaaactaaatgaccagataatagggtatgaattaaaatttttctttttatatatatttttattttttacattccatattccattccccgagcccccttccaccctccgactgctcctcatcccacactttctccccaccccaaccccatctccatgttatctaaatgataacataattactatgttagaaataaaatatcaagagatattagataataataattattatttataatttatatttttattcaattgatatcctgatcacattggatttttttttcatttattttttaactgtttaaattttcttttttaataattaattaatttttgcactccatattttataccccctgtccaatctcctactgttccacatcccatacctactcccaacccctcctgtctccacatggatgtccccacccccaccccacctgacctctaaactccctggggcctccagtctcttgagggttagatgcatcatctctgaatgaacacagacctgacagtcctctgctgtatgtgtgttgggggtctcatatcagctggtatatgctgtctgtttggtggtccagtgtttgagagatctcgggggtccagattaaatgagactgctggtcctcctacaggatagcccttatcctcagcttctttcatccttccctaagtcaacaacagggatcagcagcttattaccattggctgggtgcaaatatctgcatctgagactctttctgctgcttgttgggtctttcggagggcagtcatgctaggtccctttttgtgagtgctccatagcctcagaaatagtgtcaggccttaacccgggcagtggtggcgcacacctttaatcccagcacttaggaggcagaggcaggtagatttctgagttctaggccagtctggtctacagagtgacttccaggacagccagagccatacagagaaaccctgtctcgaaaatctaatataaaataaaatagtgtcaggccttggaacctacccttgagctggatcccactttaggcctgtcactggaccttctggattaaaatattttcaatgatattgttggcttgaaaggctttgaaactataaggttgtagcttattcaacttagctatgttgagacaaagtgtagaaggataaaaattcattggtttaaatactaaatgttcaggaaaagctattttccagtctgctgtaccacataagaaagaaccaatgcattttaaaaacaaaataaacaaccccaagtgtagaaagcactaggagaatcaaatttaaagatcaaatataaagttaactttgggactttttaaacacaggaatcactgcaaatctggagctgagtagcaagcacaatgaatagatggtgattaaatggatttagaagaactaagagttggaggaagagtggtttgatacaatatcagaaaatataaaaggggctgaggacagagttcagtgatagagtgcttgctgagcatgcacaagccctagattctaccacaagcactgcaaaaattaagcagggctaagaaacagaagagaaccctggcagtagtggcacacacccttaatcccaatgtttccaaggcagtagcaggtggatctttgtgagttcaagaccagcatggtcaacacaggaagttctgggacagccagggctatacaaagaaaccctgtctcaaaacacttagaaggaggaggaaaaaaaggaaggaagggaaaaagaaagaagggaagaaagagaaggagggagaggatgggaggggcagaagaggggagggaaatagaaaaagatttggagccatcttccttgagcaagaaattttcatttattcactaagaaaatgattacatagcagttaacactgggccctgaccaaggctggagaaataatgtgaagctctgaggaaggtcactattctgtttggacacagagagaataaggacaggggttggtcctttaaaaaaaaagtgagtgtgatgtttctcccctctggaactccagctgactccagaagtatcttcactaccttctcctaaatatgcctttaaaatagggctttcaggcatctgattaatgactgctaaccacctagccagatgtgtcaacatgccttaatcggagacctgagcccctgccatactctccacctgctccacctataacattccagtgaccctcacttattcgatgtagatgtacactcttcacaaagtactgggaactatgaagaaatggggaaataagaaaaaatggcaccatatctaacaacataggctctagcccatggtggtattctctccacttagaactgagtctaagtaagccttataaaatctttaaccctgtttgttaggctttccttacactgtgcaccctgttagaaggcacagtggttcttgaatagacctacctctacctccatgtcacctccccttaactcttccttccatctcccacttaccctgctgtgatccttcattagtttctgacaataacaggaattcggaagaaaaaaaaagcctgcagtacatttacagagtttggcttttggagtacctcttgctctattttaactccagggatggaggagtttgaagagcttgagttttgttaaccaaggaatgaaaaatctgggccacatttgagttcttttctgagaggtctctctgtacttcaaagacatttgcttgagagcccgggtaaagatccagaacactatttcagcacttaagtggggaaaatggaggataaagaattttgaggactagttggtccagggtacaactaaaaaggccaagattctgactttgtgttgttcaggttcaacaaaagcccaaggatgctaggcagaaaaaataaaaggcctgtcttctgaatagaaacattgtgttcacatcgagtatgagcttgggggggggggggctcactaacctgggggtagtggatcaggttaaaaaaaaactttgagactactgagtgaaaggaatggatgagatatttaaatatagttcatcttcaaagtctgggattctgttgaacagaacatttattttggtaattaggcacttgcttcacaatgcagctgtgggttgaaaataatgctttctgcctcgtggaaagttatgggttccacccctaatttttcccagtctctttagaaagatagaacatttgttttatccttcccaactctcccacaagctcgactgctttgtcaaaatttctttgtcttgcccatataaaagcagaggtaattatggggaacaatagttagaaactccctagctttgactgtcatttctagaaaacttctgctatctctgcatttataaaataaagaaaattgagtgccataacagcaaaggacaaagaatgctcatttactgtcaatatgctcataactgtcctcgtcgttgtcacaatcgtcgtcatcatcatcatcatcttgattcttgctggtaacttccttagtaagggcccttaagtcatgtgtcataccatgctattcttcaggtactgatgtagcaggctatatttctttgttttaacttaaaatttttttctttctcttggaatgtttgactcctttgaaattttttaaatagaaaatttacctgggaccagtggcccacatctgcaatttcagccctttggaggtaaagccagaaggatcaggagttaaagctcagcctcggctaaattacaagttcaaatccagttaggactatacaagagcctgtctcaaggaacaaggaaggaaacgttattctggtcaaacatttgcattttataaaactttattgcccaatttatttctttattgaaactttattaaaatttttatttatttttatattttattaagaacataattacattgcttcgatctttcctttcttctttccagcccctccatccatcatattccctccgtataacctctcctatgttcttccatggaggagtgggggagagagaaatgtagcctactgaatttgtttttgttgtttgtatgtacacgacttcaagggtgaccattttgccttgcccagggatgaatcccgttattcattatccagtactgcacaggatttcttttaggatttatttagtttatttatatgagtacagtgtagctgtcttcagacacaccagaagaaggcatcagatcccattatagatggttatgagacaccatgtggttgctgagaattgaagtcagggcctttggaagagcagtcttaaccactggccatctctccgcccatactgcacagtttttaaaacatatacctgggccaggtgcatgcctttaatcccagcacttaggaggcagaggcaggtggatttctgagttcgaggccagcctgatctacagaatgagttccaggacagccagggctatacagagaaaccctgtctcaaaaaacaaagccatatatccctgatagggataatattttaggggtagaatacttatctagcatgagcaaagccttgcaatcagtccccagttctgcaaaaagacagtgtgttccatattgtacctaccatcaggtacttgtgactgtatctctgcatcattaatgtgttctaatcaatgtttgtaggatagccatgtgtctgagtcagagactgtgttaagtgattgttcagtaaaataatacagactgggctggtgagatggctcagtgggtaagagcacccgactgctcttccaaaggtccggagttcaaatcccaccaaccacatggtggctcacaaccatccgtaacgagatctgactccctattctagagtgtctgaagacagctacagtgtacttacatataaccaataaataaatctttaaataataataatacagacttcagagctggaggaatggcatgaagtgaatctcctggttatttgtctgttttttgttattggggttttgtttgtttgtttttgcttcatatatcttaaatgtggcactatgaagccagcaacctagaaatgccaatggcggcagacaaagaagctctgagagaagcccaatttctccttaaaggaccagaaaagaggtatcttagctggacattgactcatccactccagctgaatgccataggggaaaatgtatcccactcgtcctttatgaacaaaaatctaacaaggagcctaaagttttatactctcagctgtaacacagtatccctaaaatgtttgccttgcacagctgggtggggtcagagaaaactgagttgtgaaccagtaacaaggccctccccctcccccacagtgttagtagagcccatgtagaaaaagtgagctttcacctttgccagactgtaacctctgatcacacctccccctgtttctggaaaggtgccaaggtggtgtcaattaaggccaaagaggatattgggactttcaccatcagtgtaatgttaattgaagtcacacaggaaactgtgccaagggacctctgtccttcccagatgtagcatagtggtgatgttgaaacatgtgtccccattgcatacactagcaagcgtttgctgaaaggaccctgatatagctgtctcttgtgagactaggccgggacctagcaaacacagaagtcaatgctcacagtcagctaatggatgggtcacacggcccccaatggaggagctagagaaagtatccaaggagctaaagagatctgcaaccctgtacgtgcaacaacattatgaactaaccagtaccccggagctcttgactctagctgcatatgtatcaagactcagttttctttaagggactggccactgggaatttaaccatgttccagagagcatatgagtagtacagattgaacttgggggcatcacaagggcagggggcagacctgggaggaccagaagtggaaaaaaaaatctgatctgaccagcagaaagaaaatgggttagaaaaaaatagaacagagtaaattccagaggataaactccaagcaatctatgttatattatagccgaacttcctaaaactaagcacacacatttagaggaaagcagccatatttgaaaatgacatctagttgatgggcataccaagtgacagatttgaaaaaatgagtcagagataagatatgcccaagtcttatgagaacagacaggaaagagaggtgacttaagagagcagtgcgtgggcggggagcagttttactgggacagtcttagagagacaggttgcaggtgaagacagaatgagacagagaatgagaaggagccagaagattagaacagattgccagttactatgaggccaagcagagcaattcagtcagaagcagagagaagctaatttgaatctgtccacttggagaggagtttgagccagagttgaaccagccatccagagatcggaaaaaactagaaagggtgagcttattcagcagtaagtctcagagacaacaattatatctggtgaataaaagttacgtcacatacacacacttacagacacacactcaattttttacaaacttccatctccttagagaagagaaaatatgaggtattttgttgggaagtgagaaagccctgtgtgaatgtgtattgttagcatgggcacagccatgtcaaggaccagtgcctcagacccatgggaaaggccaagctgtgagactcacagggatggcaaaaccttcctcaggttggagtgcaaatgactgaccagttcatgcaaaaactagtagctgctgcctcccagacttccacagtctgagactgcttagctactgagacctcctatggaggtctaactcccctgctgtgttgtgctgtacataataaacaggctaaggtcctaggtagctcccaactgttggtgttctccatcagagtgcacacaacccacctgaccccggctttttttttcatgaatgtgtgtgtgtgttctttcttcatttccacactaccctagtcaggtcaaggcgcccacctggggcatgggagttatgatgagtggagcctgaatcagttatgtctccagtattagaaactcacattagtcagacgagggaccactccctagagaagcacaagaataaaggcaaagaaaaagaatgaaaataaagaaaagaagggagcacagttgttaatgttagtgttaagacatggacaaatagtatctgaacataggtagataggtatatgttagtactctgaaattttatgtcaataaattcaaggagattttaaggacatacggaaggataaaagcattgtagcttcatcattttgaattaggtttaggacataatgcctttggtttcctgaagaatggccagtaagtttagctgcttgagaggacatgggagaaggattaatctatgaccaaaggacccgagagcattccaattttctctttgggtttgtaaagtcttaaacccctgcgtttcctcacagaggggcaagttctgtgacaatggatccctaaggagtccagcttctagacattgcccctttggctctgaaggggctgggaaccaattatgttactctttgcaagtttaccaactaattaacatagccaccttaagggttaggaggaaattgcttaacaaggtggaggggggggacttgttgctgagtcaccctgccagaaagaattagacttatattttacggcccacctccctccagattacagctgtgggacccttctggggtagagaatcctgggctgcagcttgcagccttggtgagctggtggtagctgtttgttgtggctcaacttttaaaagcagccccgagaaaggcacattgcagggggagtgcgggggctggggtgtcttactgattttcacattttttccagctttgagctcaaataaccccgggccagaggctacgtgttttgtttttctctccacagttgggtgtccagcattgctgtgaaccgcccctagactaactgtgaagatccattatgaacatctaagaaataggagggggcacgggtgtggggagccgaggaatccatgaataaatgagtattgttgacgtgggcacaggcaagtcaaggaccaacgcctcatttccactgaaagggcaaagttctcacctgtgagtgaggctcagcgagatggcaaagccttccccgggtctgaatatgaatgtggacagtgtgctacaagttctagtgtttacgaatgctggatcagtgtgtgcaagagctagcaaccgcagctccctcttggtcagagcacagtctaagaatggagtcatgggaaaggtattctcagtgcttgtgagaaaccctcgagaatacatgacaagagttttgtgacctcagtttctttaaaaacacagacctgttcttggactgtgtttttgtgcacttcctgaggtctgaggtgtagcagctaagagtgtgtttacttcagctgttgttattcatgtgcttctatggaaaaacgtggttttgccacctctgccttgttcttgtgattgaacaccttactcgtgtgattcctcttagccttcaggatataaatcgcctgatgctctgaataaagttagccattgcatgaagccttcactcacttcatttttaggtccccctctgctctcccaggttcacgccaccaaccggaccagtaaatatctcctcccaggtgtttacagtgggacactactcacctacaaagatatcctaagagattaactaactccttccttctgtgctacacataatcaatacacagaggttctggattgctctgatagctggtgcatctccatcagaatgcacatagctcacccgaccccagcttttctatatgcgtatctgtttgtgtatctgttcttcactccctcactgcccctaatcaggtcaagtcccacccacacagatcatgatagtatttgtttttgtttgttgttgttttctgcatctggcttttttcacatagcatacacattttcagttccattctttttttctttaagactgaataaaattctaatgtgtaaatgtatcacattttttaatccatcctgttggtggacatctatgctggttccatttcctagagtttgtgactatggatgtgcaagtctctctgtggtctgttggattagactcacttggacgtatgcccaggaatggtatacaagatacatggcagactgatttttagggtttgaaaaaacattcatacaaatttccatgctctctacaccagtttacactcccaccagcagtgtgtacatgttcctttccccatatcctctccagcattcgtttgttttcagaatagataatcagaatagtcattatggttaggatgaaatgaatgctcaaagctatttaaatttgcactcccttgatggataacgatgttaaacacttttcaagtttgtttttgttgctattgttggtgagaggttcttacataagtctctgtttcccgtctgactcacgatgcagttgagaatgggtttgaactccttatcctcctgcttccacctcacaagtatgggaattacaagcttgtgtcaccatttcttactttcaagtatttattcattgcttatatttcttcctttgaaaactatttagttcattgatacatttatagattggataattgggattggtatttaacttttgtagttctttacatgttttagatagtaattctctgtctgatatattagtctgaatagagagagactatataattctgaaatatacatgacaaagatttttgtcccattctgtggttgtatcttcactctggtgattatttcctttgctgtgcagaacctttaaaagtaatttcaaaggtcatgtctgtatttatacaactttcatcttagtattttgggttttttgagacagggtatcatggatatcaggcagaacttggactcagtatgtaacttaggctggccttgaactcctgatcctcctgcctctgaatctcaagtgctaggatgacaagtatgtgtcaccatgctccgcttatgtaactttcttaaaataaaaatgttatgaagacacaatagaagttagtgggtgttgttaggaatcagggatggtagcaagaacatctggcatgactataaatagatggtaaaaaggagaatctttgtgatgttgaaatagttgtgcatcttaactgtgatagggatctttgcataatgaaaggacacaggactattagcatgtatcacaccactgttggtttcctcattttaatattgcactacagttacataaagaaaaattagggccgggtgtggtggcacatacctttaatcccagcactggggaggcagaggcaggtggattcctgagttcgaggccagcctggtctacagagtgagttccaggacagccagggctacacagagaaaccctgtctcgaaaaaccaaaaagaaaaaaaaagaaaaattcggtaaatgattcatgggatgctctctgagctgccttgactgttttctgtcaatcaattgttgtttcaactttttaagtttttgaaaattagattaattttaaaagctatgtcaaataaagtgtaaacttccttggacaatacaaaagatatttttatcagttttcactgtactgtagatattcagaacagctcagttatagagtgtctgaaagacaacttactgaattaatagttttttcttcacgatgcaactgaggtatttttaagtcaggatagaacagtgtgtgagtgtgtgtgtgtgtgtgtgtgtgtgtgtgtgtgtgtgtgtgtgtgagatgtgtgtacctcaagtaagatctcaaagtggtacaccctgctttcctgccctgccacttttagtgtcaggaattgaatctaggtcctcatacatgctagccaagttctctttacactgagcctctgcccctttaaaaaccaatgtaagatttagaaatacattttacatgtagaaatagtcacatttttgtgtgctcagtttttggttttttgttttgttttgttttgttttttgtttgtttcgagacagggtttctctgtgtagccctggctgtcctggaactcactttgtaaaccaggttggcctcgaactcagaaatctgcctgcttctgcctctcaagtgctgggattaaaggcgtgcgccaccacgcccggctatgctcagtttttatgttcgcatacatgctaacacacactaccactgaaccactgctgctaaaattccttcccagggtgagacataaataatgtctaccccttctcctaggctactagcaacaaaccaagacatgatcctacccaagttcattctggggaacaatgagtttattgggcttccttatagagcatagatgaagaattacttacaggggcatgggtgctcttcccacaacaggaaaagccttacccaacagagatggggacttttacacagtcacatagatgaaactatgtggctgcacccatttatttttgcttccctaggccatggacaattaaggtagcattgtgtacaacaggtagtaagaaacaggatactccagtaagactctcctgtccctgtaactggtccttgctatattgtgggttctctgtttgccaccttatatcacccccacacttcaccccctatcactagataggagagaaagaaggataggagatggaaggagggagggaaggagggagagatatccctgaatctaatttctttcttctttcctttcttctttgagcatgactatcaacaaactacaaccaaccctcctgaatgatcttggagccctagcgtttacataccctctgaaaagttcccagaattccaaatgtcacacaactgcagaaactatctacaactggcaaaactttatctctgctaaagcacgaggcaaatcatagtcagctgctgtggacagtctaaagcagagccacatctctacacctgggattaaaataaaatcacattcttataatatttctgtattcttaaacaaaccaaacttccaaaattctcaatgcatgtccctctctgcgcctttgtgctggggtgtaattcattgacaagcacacctgggatgatcttttccaaggggatgcagctgaatagcccaagatggcggtttgctcagaaaacagttacttccaacaaccatacaccctcaaaaaagaactaccacagtcaccccaaaatgttcactactgtccctctctaataaatctcacattcatcttctctttgtttttctgtccccataatgcctttgagaattgtccaagttgctttgtgtatcactagtttattactatatgtgggtgtgctatattttgcagtattaacatatatgcatttatttattcttttaccagtatatgtgaattgttgtcaggttttatcaagtatgaaaagaacatactataattattgataaccagggtcattggattgttttggggtttgttcccctctggtagtactaggaggcatcaaacccagaacctggtacatggtaggtaatgattgtctctgagttacaccttcatccctaggtatagtgttttgtatagacataaatattaagagtaggatttcggtgggatatgttaagtgcatgaccggcttcatgagaagttgtcaagctattttccaaagtgagtctagaatttttcatttctgccagccgtgtatgagatttccagctcctctatatccccccaatagtattaaccatttcataggtagtcttcttagtggatgtggaagggctgtgtcattgtgaggtttcctgtgtatttcgttggttggttggttttgctgttctgagagaacatcttaccatgtgaccgaggctggctttgaagtcttactcttcctacctcagcttctcaagttctacaattgcaggctatttaccagctcattcctgactctcactgtagttttaatatgcatttctcagatgattaaagatatttatcaacttttcatgggcttagttggtattcattttgtgtgtatgtgtatgatgtgtgttctagattttcgtctctgggttgtttggtggtgttgtttttgtttggtttggtttggtttggtttggtttggtttggtttggttttttcgagacagggtttctctatgtagccctgcctgtcctggaactcactttgtagaccaggctggcctcaaactcagaaatccacctgcctctgcctccccagtgctggaattaaaggcatgagccaccaccgcccagcttgtctctattttaaattgaattctttgtattcttcctgttgaattgtgataattcactcaaacttgtgtgctgaatgtatattttgccagatatatatgttgcaaatattttccaatctattacgtgccttttcattttcataacttttaatatttatttcggatatgtgtgatgtgtgtgtacacatgtttgtgtgtgcgggtacatgcatgtggaggtcagcggacagacagctctgagtgtcagcccccactctccaccgtgactgatgcaggctctctcttgttgtttgtgaccatggtgcacacagtgctagctaactcacgagttttaggaggttctcctcccagctcactgtagaatactagaattaaagacaagtgatacagtgtccagtttttacatgagttctgggaatgcaagtcatcaggtttgtgaagcaaatgtttttcctggctaagccatctctctggccatcataactttttttttaataaaaacacagaagttttaagctgaatgtggtaatgcaaatctataatctcgtgttgctaggattccttccctggaagaaaagtaaacaatgtctgtcccttttcttaaggtcccactgacaaactaaattaagattccaccaatgttcaccctgggaaacaaataaatttattaggcttacttactagcagtgggtaagggattagacaggaacataggaggccttaacgtcgacacactggaaggcctgcacccatcaggaatgatggcttcttattggctgtgtagatgaaaacccctctcttcagctgccccatccatgtcctctagcccctccccctgagactaaggatattaaaggcctaactgtacacactggttgggagaggtggttagtttcaggacagcttgggctacatcagactttggttggttggttttctaaggatacattttaagttttgataaagtctagtggccaatgtttcacttataggctatactttatatgaacattctatgagatctttgcttacacaaattattttctcctctagtgtctttcagaagtgttatacttttaaaagcatacttttatacttttttatgcatttaaggctatagcccatgttgcattgatttgttctatttgtttctcttagcatttccaaagctctcttctacataggattacatgtgatggttgtttgatttgaaagcactttgaggactgagctggtactgtggctgagtggtacagaacttacctagcactatgaatccttgtatttagtccccagtattgccaaggaaacactttgggggaaagcacaacaagaattttaatctccaccccctaagtgggaaatttgattagggaagcattgtgtgatttctcagggtcccacgtatcataatgggtgaaactgacatgtaagtccagattccctgctgtcgtgggccaggaattttgaagccaggcagctagagctcagaacaacagcctagcaaagtgaaggtaattcgtgagaacgtcttatttggtgctaaagcataaggcacaggcaggcactggcagtggagtggcccttccctctggctcacttggggctgttcacttggaaggagaaagaaactggcccagcgcccttgctcaggtgacacacgctgaatgctttttgatgatgatgatgaagtcctggaacgagttcagagaaggactctgaaaataattacagagttacaaaagtaaattgaagctgaaaagaaaagtttaaaggaactaagattatttaacctagaagagagtggctcaagatgaaacccgataacagcttttaaacaaacaaaaaacttgggctctccttctgagggctgagcaaggggaaatgggctggaagaatgtgagtaaaagggcaccagtcctcctaggtgaggactggtacagatatgcatcctcaaaaacaagataaactcgttcgagtttggaggttagagatttgccaaacgtgagctttggtgatggacttcagcatgtgggctccatggccagcttacatagcatctctgaagatcttcaaatggcccctgaatatactctatattctagtgcagttccagaaggcattttttttggctatgatcttttcttgctccttaatcttcatattaagatttttagcatttagatttctgtttcaaatcctaaagcttgccctttaacctcctcaccctcaaatccaagcatctcaattcctgaagctacatatctggcctagtatccctgccttctgttacagaactgactagtccaattcaggcacccccatttaaatcccgtttcctatttcacctgtgtttgcatagcactccgattatcagtgccaccatggagaggcagggaaagaacagaggcatcactagacacaacagtaacccctggtgtctctgtgctccttttctctgcagcatgggtcggagccctcgctatgggcatgatcttcttctgttctcccattgtgagtatattcactgaccgtttgggctgccgaatcacagccaccaccggggccgctgttgctttcattggcctccacaccagctccttcaccaggtaaggcctcggttgctggctacttttccaaggctgaaagttggcttcttccttggggctttagctataagcactgttctcactgcagtatcctctgtggccctggccatgtagggccctcaaagacctttctcctaagatgcagaatccaatgcaactcactttatgtggagtctgcaggatacatatgcaataaataatacacacacacacacacccaaaaaaaggacccaaagttccaaaatattgtgaggagtctaagcctggtagctcacagatctcaccttcagtcctgctttgaccattgaattgctttggagtagttgaagagcatcttttgcctgtctgggcctcactttctatatctttaagagaccacatggtttccttcagatctctccaagctcccctctaatgtggcacacatctcacagaaccttgcctttcctccctggagtaaactacttacgtgagctaatgtgaagatggagcatttccagatgaatcctcagctgaaaaccagctaataatcagagtatatggctagttaacatgtctggtcccttttctgggtggctctggctctagaaaggcaggtgagccagacatagagggatcctcatgtcttgggtgtgggaaggatatttagcaacattctccactgaagtgcagacctaaaccccagaaacccagctaaaacttcaaccctagactcactggtggcactcagaaaattggcagtgctgggtgagaaggctacacattcatttctgcctcctttcctgtcaaccctgaacaagcatgtacatgggggaggggagaataaagaccccatcgtacagtgagagaaatgtgagattcctaagcaagtctgtggacttcctgctagactcgtagcaagttgtgatccctcctcttccaatcttcctggactgattaggagattgatgactggagatacgaacatggccacagtgacatgtctggaatggagactgagctaacttgaaagaggcttgctttctgggtatgactccccagagaaagccatggctctctgggcttaagtttccatacacagtggagaatgagactcgtgttctatctcagttggccccatgggggtgagccaactgtcctaatgacttaagcatttccggctgcccagactaccctccagcagagcttagatttggcttgcactggtgtcttggttccaacccatccaaccaagacaagggagaggggaaaccatatcctgcctcgaaccttctcagttctcccaagacagaagcagcagctccaaactttcagaggacctttctggtggtcagcctcatctgccaccccccaacccccaggaagctggtaccagactcttgtgggaatgagctagacctctagtctcagtgctacatatcaaagccttgtttcttcaggcagagcacagcaaagtgtaaacaaattagcaacataaggatctcatttcctttgcagcccacatgggctgtggcaccacttcgatgtggtgttttctcctggcattcttatctcagcccactggaggaggccatggccccctattctgtttgtactttctgtaagaacattctcagagccaagaaaccctggatggtttcatgtccagagggaagaacatgattttgcttgtggctagaactccaagtcattgctattcctattgtctcgcatcagggctctgagtccttttagatgattgaaacagggcagatcacaggcggcactgatgagccctgagcaagaactagcaaggcctcccatcctggagcccagttagaaacattcaccttacagtgccctgaactgaatcctatgtttcccctaagactattttctttaagactagcttctgtcctttggataagaccccagcccaagccaatcccataggatacccagaattgaatggaggaagaccccaaggagtctaacagaagcaaagcaatcaccttagctgttagttcaaagcaaagacaacctgttggaaactaaaccctactctcgtccagtgaatatgggtagacagaggcaacaaatagggctactggcagggtaacctaagtccaggtttttagtataaaagctgtgtctgtgtctaaagaacaagaagagcattggctaatttcatggccagataagaactattgcaaaatatatggaagcatcaaaaacaaaacaagtattctctaagttgtgccagcattgtgtgagggcagatggctagccaaactgacctgcccgtggcctttccccttctaacactttgccttctgttacagaggcttgtggcagagcagagcctaagagttttaagcaacagtctgtctttcttggctaggcccataacctgaggcttgacttcctgtcaatcaagcaggctacttactctaagggaactaatccaaatcgtatgcaacaacagagacaggattctggaaactaaagggactccttaactcacggtccctgtatagatcacctggggcttgagcaaaaaggcttgggctctctcgaccttgggcaagaatgaagaaaaaggaagttctcctgagctcattagccagtctctgaaatattaagggccctgaaaataatgacacaccaaagaacagctcagccttccaagaccccagagtcttggctccttacagacctttgttgttacctcggatgaaactttggtccccacgtctacttgtagtgtctaggtaagaagcaaggtaaaactaatttccctatggcacagactgacttcttgcagcctcttgcctaaccactccaaagcttacttctggttttcttcctttcgttcgttcacttttttttccctaatcctctctcatgggatgctataatcacactgatctggattgaaatcctagctttttttttttaaatgagacagagacttgctgtgtagcccaggctgccctcttgtcttagcctcctgcatgctgggattataggtatgtgtcaccacaagtgtcctaaagccaagcttgttttgttttggttttgtttttttttttttttttggtttttggggttttttgttttgtttttttgtttttgtttttgttttgttttgttttgttttttttggttgctgggatttcaatttaggacttttggaagagcagtcagtgctcttaagtgctgagccatcttcccagcccccaaacttttttttaagtgtctggacaagcaactttactcttgatcaaaagggcatcctaggaagaactggcacatattaacagagcatgcccttgtttttagtctaactgggatggtaattatgcctttttcccacttgctggagtctgacctcacagtcttactcagttgactagtcttaaggaactgaaagctaactgggcagtggtggcacacgcctttaatcccagcacttgaggcagaggcaattggatctctgagttcaaggccagcctggtccacagagtgagtaccaggactgccaggcctacatagaaaaactctgtctcaaaacaccaaaaccaaaaacacccccaccatgctggggggtggtggtacacatctttaatcccagcacttgggaggcagaggcaactacagagcaagttccaagacagccaaagctacatagagaaaccttgtctaggaaaacaaaaaacaaaaatacaaaaaaacaacaaacaagcaacaaaaacaacaaaaagccaagcattttttgatctggagttactttaggcaaactgcctctgcatccccatctgccaagtggggttcagaggttccctatctgctcggcaggttggtggcgagtgtggctttgggtaaaggtggaggaatggaggtttccaagaacaaagggggcaggtaagttgctttcaggccgctgaagatagctcttggtgtttctcccacagctccctaagcctgcgctacttcacctatgggattctgtttggttgtggctgctcattcgcctttcaaccatcactcgtcatcctgggccactactttcaacgtcgcctaggtctagccaatggtgtggtatctgctggaagtagcatcttctccatgtcttttcccttcctcatcaaaatgctgggggataaaatcaagctggcccaaaccttccaggtgctgagtaccttcatgtttgtccttacgctgctctcactcacttaccggcccctcctgccaagctcccaggacaccccaagcaagagaggtgcccacaccctgcgacagcgctttctggttcagttcagaaagtacttcaacatgcgtgtattccgccagcgcacttaccgtatctgggcctttgggatcgctgctgctgcccttggttacttcgtcccctacgtgcacctggtgaggaagaagctgacctcaacctacctggagtccaaagggtgggggtggaggacattgaaagggtagagctttggaaaaagaaacaagcagagccaagcatggtagctcaggcctttagtctcagaattgggtgactgaggttggagggttgctgtgagtttgatgccagccagcaagattttttctcaaaacaaataaacaaaagggaacaaagacttaaaaaacaaaacagtgattgtcgattggcagagaagtaaagagtatgggttcaacgagaacttcagtgggaaatgaaggtagttccttaggacaaggcccattatccatggcttctcccatgataaaagttttgatagaaatcaggcttgggagtgcaaacctgaaatcccagctacttaggaggctgacaaaagggataattcaaggcctgtctgaactatgtacagtattaattcaatccagtctgggaaacttatcaaaagtatgtctcaaattaaaaggagataagggcctacagaagtaaaccagtggtagaatgcttgcctagcatccacattaccttaggtttactccctagtactgaaaacaagaggtttaattggatagatgggtttcagagaataagcgttactagaagagtggttcagatgacccaaggcatgatttataaagaccatactgaggcatgctggtctctgtggtaaaatgattctgctgagaaaatagcatggataggaactctctagattcatgtgtaataatctctttaccatagtgataaattttgcaatttttgagcccattggctacagaactcttggttgtagggcaaccattactctataccaatgttgaggttttgtatgtgtgtgcatactaaggacagaacatagggccttgtgcctacaagcatgcgctttatcattgagctacatccccagcctatagacctcatggttccttaaagcacactttgaaagggttgcctgcaatttggtagacccttacctcctagtgacctgatatttcagcctgctgattttaaatcattgcatgaggatgtcatagaagaacatctagatttccttagtagcttgtcctgttggagctctgaggacttggaagtgtctagccctacaactgtttcttaaaagcacattgcagagagtcttcgtgattactagaagcagccagggggttttcctggagctgggggacatggaatgctactccagtcagaggctcttgtcctcatccagagaagtgagtagcagaaaatcgcggatgttccaacatttaaccagtcagctcctctttctcctcctgttctgggggtcctggcattatgcttttcagatgaaatatgtggaagataagttcaaggagatcaaggagacctgggtgctcttggtgtgcattggggctacgtcaggcctcggacgtctcgtctcgggccacatcagtgactccatccctggacttaagaagatatacttgcaggtcagtgtccactggtccacagtctacaataggtcatccctaggctctgggataggatggatggcgaagcagtgcagttctctgggtctgagctttgcccatggtagataatccaattctctgagcctcgtcttcccctgcttttaaaggcaatcatccttgctctcctttctgcactagcatagagtaaggatgccgtgagagctgtgtgtatggacccttgcacaaatatagcaggtaatttgtattaacagtaacccagcaaatgaaaacgggaaacacaggccacgagccggatgtgtcccccaagtaaggatttgtttaattgctataatttgtttaatacctatcttgaaatctgaagcactttatagcccagtttctctctcttctatgccaggcccgtcacctctcacatttccagagctacttagcatcaggcactggctctgaagtgccatcccaggcagagacaggcagacctctgtgagttcaaggtcactctggtctacatagcaagctccaggacaccctgagttacatagaaagacattttctaaaacaaacaaagaatcctggaatgcctctgaccactggacactaaattcatgccagaaaaggccaaatctcattctttctagttctcacggcccttatttgcacagtgaaaataatccttgctattaatatctcatcagaaaagtgagcacctaaacatgtaacgaggtggcccagtttagttcttttgacagagatacaggtttcctcccactgtgggcagtgaccaccctagtgatactctactgatgtgtgtgtgtgtgtgtgtgtgtgacgtgggttgggtctggtttgaatacaggcaattttggcctgcctagcggcagtagtgcctccctggcctcactcatggttctgctcctgcaactggacttgccaagagatgccagactgcaaagccttgtggaagagcaaaggcagccacagaacacaagcaatcacaaattattcaccagagagaagctgagttgggacttacttctctcctgggaatgccttaaaagtacttctaagaagcccttgactatttgtagttgggattccatggtctttggcagtgccaagtgagttccttaataccatcatgtgtcatggataagaatatgattaattctcatgtagaatttacttcaactagttgcaagaactggtggagagcttccccagagttttgggttctcttgtagtccacccaggccaacctagcatcacactgaaggagaacctgagagacaggcttcttccacagaagtggcagcgctgagctcacgtgcagcatgtttctcatccctgctgtcctagtttgctttctactgatgagatcaacttggggagggaaaagtttactttatcttacagcatatagtccatcatggaaggaagccagggcaggaacttggcagccaaagctgaaacagagcctgtggaagagtgctgcttactgacttgctcagcctgccttcttatagaacccaagactatctctctgcgcagggaacacatcacacgcagtgagctggggcctttctagatcaatcatgaatcaataaaatgtccccataagcttacctaaaagccaatctgatgggggcattttctcaattgacgttccctcttagataaccctagcttttgccaagttaacagaaaaccagaccagcacacctatctttctctacatgatggatggcaggcaggcccaagtctcagagataagtgacctgcctgaggtcaatccatgagtttgtgggatgaacaaattatgaaatgtttagatcctgtgcaaatatcagcaagtgctttatctgagtggctttttgcacatttgtatcatgtgcgccccgctcccaagcctctttcatgtgtcccctaccatgggtcttccctaccaggattagcagcttcacaatgccagtgagttcagaaaaatgagaagaagctggcactgtgccagaactctctcttgcagcgaggcagcggcctagtgtggtagcttacatgcttcttgccacaccacaggccccagcacagaggcaatggctgtctgcttttgctttctattgtacagctagagttccaagggacaaggaggtagaactagttagagactgagctagatagaacccaggacttctgctgacttccctcatttttcttcctcttacatgatccagattcaccgctttgaataatataaaataacatgagaactcagctgagacatcttcatccccttagagcctgactccctcgttttatgaattttgagggtttggggctggggtgggtgtggtttactcagtaaaatgcttttctcataagtataaggatctgagtttgattgtgagaacccatgtttttaaaagcttggcaataacaaaaaaggggacagcaagatggctcagtggtgaaggtgtttgtcacacaagcctggcaacctgagttcaatcctcagaaccaacatgaaggtaggaagagagacccaaccctctgacacacacatacatacatacacatgcatgtaaacacacacatgcacgcactcacatatgtgcgccctcgaatgataatggtgctgcttacttgtaatcctagcactgggtgttgagagataggagagtctctgtagctccatacccggccaacctagtctaactggtaagcttcaggccagtgagaggccttttctgaaaagtagacagccttcctgaggctgacacctggatgtcctctggcctccaatatgtgtccacatgggcacatgcgcacgcacgcacacacacacacacacacacacacacacacgcgcgcgcgcttttttaattgagtatttttggaccaaagcacaagagaatgctcatgggtttttttttttttcagtttttcaagattctccatcacaggaacctgccatctcttactctcagtggcagatgcaagagcactggcatgggtgagaaaagggcagcacatagcttcaggtgctcaagagccacccaggagagcctgtgcttctctacagtttgtgaagccaaccaacgtgccaggcatctagctcctgaatagcctgttagaaaagaaatggaaatagcctaaatgacctcatttggggtcatttttgaagcctgagttccagttcaaggagggattataaatttccaagccttgacaaggcctactgaaggataagagagatctagatacatcagttagcaatttcagctgattaagatctgttcatggggtccttggtggtatagaatgatattaactcttaactgccatactcggcttgattgataggtgggtctgattttagctcatagctacatgcgaccctcttaaaggagaagcaggtgtggctcagttcttattagttcttattattagcttctacctaactacctgaaaatggcctggaacaaattcaaagtttcccaacaaagacattctaaaatgtccaaaaagcagctaatgcccaacaaaatcactgtcagcaacaacacagaactgtgggccactagaaaatcctcgggcttcctaactccttagtaaacagatcaggtcttagttctggccctgagatgacctggctcgcccagcgcagtgagttgggaatgggggctcctctctatgcccacagtccaaggcttcagtctagctcccagacactgattgcaaatgacctcaatttaaaaattagagtggggcggaaggggggagtttccagattgggaaaaaaaaaaaacctagtctctagaaagacaggttctttggtctggagtaattttgcttagcctaaggaattcacagtactagccagtgcccctgggctgctccactccggggctactttggggctctattagcttagcagctcccttgcacagcctctctgttgccttctctgagtatgtagccatgcccagcgcttcctagagcccaatgcctgccatgcctgagacagataatatggcccatatcctaaaacataagaaaatctgagtgaacctcccaatagtctctcttagactcagttatttcctaaacgaagatggacattgactgctttattttattaagctgtaccttgcatcgaaagtccaagctaatcatcgtacaagccttcctcacctctgcccttcttcccagccttacttgatctgaaaacaccaatagggcttgatcccagaccctgtctcaggatccattgtaaagaccaacttctttgcctatgggcaaggcaatgccttccccctctcacaacttttttaaaatcctgctagattcagctaaatagggctggcccctctaacagacaaaacccctcagtgaaggacttagacagggcttgagtacatagaaaatatactcttaactgttctcagctgacaccccacccagtcccattttgcagatagtagaaacggagattttagaaaagaaatgtaatctgaggttcttgtttctctaggtcctctcattcctgctcctgggcttgatgtccatgatgatccccctatgccgggacttcgggggccttatcgttgtctgcctcttcctgggcctatgtgatggcttcttcattaccatcatggctcccattgcatttgagctggtgggacccatgcaggcctcacaggccattggctacctcctgggcatgatggccctgccaatgattgctgggccccccattgcaggtgaggctaatctctaaggaaagtatgagtctttcacaggccttagctctttggagtatctctgcttgagaactcttcccctctgcttttctgtataaacatcttcgttggactgcatgaaactcctgatggaagagactaaacagagtacatgggcatgggttgtccaggactgcagatgctaccctaggatttcactgtagacagcactgccccttccagcgagtagagagaaaagtgtggttagccttctcaatcactgtgcagcataggctgacctggaacccacaaggtagactaagctggcatcaaattcttcatcttcctggtatagccactcaagcattgatgctttacacgtcacactgactttagtttaatgttctctttactctctccagtcaagtggttaatttcaagttagttaggtaaaagaagaggtaaaagaagaaagatgcccctggttttactaaaacttatagacaccctccacttcctgctttggaacgaaacccatagtagagatttagttgaggaactattttaggatggtcaaaatgctggtgtgacagacagctcaatctccaaatctcttcgtccaccctcccagaaggacataacgaatactcaaggaacaccagaaaccagaaaggtagctcgtttgtttacttcttctaggcttgtcaaatgagctaattcaaaaaacacccctcaaacatcagtgcattgtgaagacactatgcaagggtggtgaatctttcactcaaggctcttgtgcagtaggaacactgtctaccaggagaaacctctcctcagccagagtaccagagaaccacaattctatccattttgcttctttcctgagtagatggtaggacaagagtcttcttgcctttcttaggtcgtatttctggacttgtcttcacaatgtgtcttctcctattcgcttcttaggtaagcttctcgcatcaagtacatacatggtattggcagctggaagaacacaaagcactcatgaactagaagttacacacattcagcttcctcctagggcaactggaactccagagaaagggaacttcagagaaaaggccaacaggagggccagcaagatggcccggcctgtagagtgcttgccatgcgagcctatggatctaagtattattttttttaagatttatttatttattatatgtaaaacaccgtatctgtcttcagaaccattctttggagtcttttcaactcaattcctttgtgacaccagccataggagtgactgaaagatggcaggtagcttaatgaaagacaaacatggaaactttaaaaagaagcttctttggcatctttgataatgagtgttcacttcaggggcctagagccttgaagttgagagtccctgaatcagggcagcatgggccaatgctattgaaaggcacgagaatgcaccccctcaaaagagaagagacagtatttctgggttgcaggggaaaactaaactaatctcatgtctcttgaccctctcaggcctccttcgaaactgctttggtgattaccatgtggccttctactttgcgggtgtccccccaatcattggagctgtgatccttttcttcgtccctctgatgcatcaaaggatgtttaagaaagagcagagagattccagcaaggataagatgctgtcccacgatccagaccccaacggagaactgctgccaggctccccaacacctgaagagcccatttaatgcctctgtcttgccattgtgtgctccttcccccccccccactccacccctcatcctaccctgcttagcatttacattttttgccaccagcacacttgttcccaaacctgtgcacacagcatttcagccacctgaccatctcctctgagccaatgctctcggtgttccaaactcattaaccaaattctccccatgaatgccttgaaacttgccaggctcttctcccagaatctgggaaagtgtgggatcaccccctggcctttggatcctcccccatatatactttctaactctttgcggggaggacagggatgggatctctagccccagattgttagtcacccactacaatcaattgccaaaggtgctactgtgtccccagaacccagtgagacagacctaagcctctgtttgctgaggaatttgttgccatccatccttgggaaccatttgggaattgtgagaaggaaggccaaaggagaccaggagccttgttttgcatcgaagctcctgaggactctgcggcaccccatcatatggttggttagccgtctgcttcccttttcctttcctagtattttctctctacttcctcttctccgatttcttcccctctattcctttttattagtgtcatgacacataggtgcttggagaaaggaaagacccagagcttgggccaatccacttcattctgacccagaccatccctaatattagcattaatactgctcatctcaggttgagctacatctcactttctgggctcaaactgatatggactggaagagcaggctatcgcatagggatgggaatcttcaacactacagagttccatgtaccagtcactgattttgacagattaaccaagaggccttcccagtttcccatccttcccacctgtcaaatgtgaagaaactcttctcatctcatgaaacacaggaggaaagatgtcagtgcactggcattagaggagatgctacggttaacggtttggggaaggaccaactcctccgtctctcatttttcataagaggtcaatatttccacctgggccaggccaagaaatgaactgctttaaggaaaaaaaaaaaaaaacctcattctgtacctggatctccaaatgacataggcaacaactgcacgtaggggttggataatttcttttcagaaggggaagccaccctagcctttaccacccacccagtctgtcccccattctaggcatcctggaccactctgctgagtgggcattataggtgccagaaaaagtaggctctggaccaccatcatccctttgaagttggtgccagatattttcctacatccaggctctgggcaacagtcttactgaagcacattccaagtgcccctggccagaggcaaagggcactgccagcctcgtccagttgtacggctcacctcattagggactcagcctctctcctccctgtttctctctctctctgtgtctctctctctgtctttgtttattgtgttcctgtaccaaccttttatcatctttttgccaggcatcctggctgttacttggacccaacaataacttgccaccccaagctagggtcatcccaaggccaggaagatgaggttgctctgaggggctccaaagaatacaatggtccccacacatgagtttttccgttactaacaggcagctggggcatagttggcctctgatgtttcattcaaggccaaagtcctgagcccccctctgctggtcccaatccagctcttatcaactccccaaaggaaaacccattggttcttggctctgaggacaggaaggggtggagtcactgtcctgtcaactcaagcatctatggaacaggagaagctgggccccaggagccctgcgactcccaggagaggccattgaaaatactgaagcaacaatgcttccacttccatttctccttaccccaccccctccaggccacttagggggtagggggcagaataagtgtgcagggcctcctttgttgctcatggctggacagctctaaagagtcaggctgccactcacttctctccagatgatggaaagacattcacaggtcccagatctgcccattcaggtgtcacctaacattggcagggtgtcaatttacttttttatttttcacaaatgcgtgtgtgcacgtgtgggcttgtgtgctttccgagagaatgttgtttggccaaagcagcacagtattaatatttagagtaggaagcagcctcttaggcaccacagttaaaaactaagagaacgaacaaaatttcagagcttgagacctgggacatttaaatcctcaaggggtttggaacaaaataaacagatctaaatgtctggtttgagtgtgtacattgtctacaagggcgtaatagttttaacctgatcaacagcaggaaatttagcttcccaggtgaagtttcattccaaacagtatttctgcctggttctctgtgctctggggaagctgacggtggaagagagaaactgagggaaaactgtttcagatggaaattttgtatggtcccctttaatgggaaaagtggttacttcacaagatgagaacatcttactggctgagttagaatggaggccctgtcaaggctaggctaccacctcaagagaaaggtgacacactgcaaattcacaaatacaatggaccgccatctgtcctcctttattttattgctgggctacttaatgatgttagaatagctcagttacacaaccccacaggcacagtctggaacaaaaggggatacatgagagagacaagactgtcgaagccaagagcgaccctaaagtcactttttatctcgatctgaaatggggaatctccatgaggcttaggaggggctcttacagatccacagttcatcagtgacaaggaaagctaaggacttgtccacttcattcactatgtagcgtgttcatttccaaaggagtatcagcgggaaaactaaaagttgagcaaattttcactttcagcacactccttctccaccattatcctccctcctaagcagctcggaaccctggtaccctccctcccggccactctagacctttctgaagccttggccttagaaacctgactccaccaagtgttcttccactcccaaccacccaaaaggtacaaataaaatgcagctccctctgtccctggactagacagagaaggaacaaagacaaagaactggtttcctttgagaaaggatgctttaccacccagctcttgactattcttgtttctccttgctcagtgcagacacccttgggttgctggcctcctcgcctcctcccactaaggctaattactctgtctcaatgccagaccccaagctctctcacccaagatcctctgcccgttctgtgcctcctccagacccccgccccgcccctcctcccgcccccagggctcagtctgtgtttgatcactaagaatcattagatttcaaagctgtagaatcccataatttttttatgagcatatgctcttcccccggggccttttcatgtctgaaaaggcaacgagcagctccctacgacttctccacagaaacagagcaggccagctgacagggattacaatttccagtgtctgacagctggtaccagaagagagtgggcgctgctcaaaacaagaagcttaaagcaagttgtgaaattctgataagctaaaacagcagtagtaaagagctcaggagaaaaaaaaaaaaaaaagaacggggggaggggggcggacggggggggggcggagaagggttgaataccttcttcccttctaaggggtgaggaagttgtgcttcaaaatggctttagatgcttgcctttcagctctctctagcggtcaccagacacacggcttcatggctggattttctggtcatatcagtgtcagcagtgttgcagtgtttcctagagacctgctgtgtgtctggcacgctgcagagccagagaacttaaggcatgaaaggaatagaatgagacacaatgattaagacacagaaggaatttgttctatcatctttgcaaaggaggacatctttccttctcagagtcggtgtggcctgttacataccaatactggcgccaaaatttagtcctctccgggacaggaaagggcccaccacgcccccacccagaccgaggcgccccacgccctccctctccactccctgcttcagacctccggggccaatcgcccggaagaactacccgcgcctcagcgtcggtttcctgctgagtcccagtcggataaaattagcccattgctctcctctgacaagtgttggagccacagtaaagcgggggaggggcggagccgagccggatgctcaccgccaggctccctccccgctgcccatccgcaccacctgtcgcgtgcgctcgagggccgcagcctcccgactgcccaactgacccgcggggcgaccctcgccctgctctccttccccaccacacccaccccgtgcgttccctcagtggccagtagcacagagccagggctgcacgttgctctgtgacatcgcccctgagccctgcaccctgggaccatctagttgtgcaggcagcgcaggggacgcggctagggctgcgtcctagtctcgggcaaaacgggaggcgggacattgactccggctgctcggcagacctgggtcctctccccagtcctggagagatgacaagccttgagtcgtaccagggaggggcatctactctccagctcctcctgggggaagagagtccaggagcagccccacacctcagccctgtgggcacacagcagctgccacaggtcccagctccgctcctccaaggtgatccgcctcctccaccctgcccaccaccgcccctgccatctccactaatatttgcggtgaccacggtgccccacaccctgtatctccagccctcgttgtgatcctggatgggtcttcggagaaccccttccaacgcgtctgctccggtcaccacgcagggtgctaaatggacactgcaagcaaagggcctgaatatgagtctcggctgaaagttccaagtctcctgccagggacagccatcgtcctccatgcattcctcaccttacctgcaattcaggcaggccccatgccctctccatccaggtctgcccggcggcctgcttctgctaagactggaagacctagccttcagtcactccactgcagcctcaactgtcccagagggcgtggggcgcctcggtctgggtgggggcgtggtgggccctttcctgtcccgatagttggatagttggagcatttccacaactcaggacagatccttcctaaattccctcagaaagtgagcaacagccagctgctctgaagtccctgagagtaaacagaacttgcctggctggggacccctcttccaaaggtagtactgagccttggcaagtggggagtcacatgttgccctgaagataggcccttttccctcttctcctcactacacattcctccactaaatcaccactgacctgctcccttcagcctagcagaagtgactcctcagacacccccaactgccccacacttaccaggtgtgggctctccggaaagtccaacttttcagcttgcttctgtcttgggcaaagtcagtgctgcctcccagactgttcagccagatgtcggctgctttgttagtgctcaggcaagtgctccctttttccttagtaaccaaacatggatccctcctccctgtgtggacagaggttccctttcatgggaactaaagctccttcacccgtagacaggcattcacagttcacacagtcctcccacatcacactggatcctccacctatcctgggagacagcagctcttaggcccaatttacaggtggaaaagctgaggcccagaatgggtagtgaatgtcagtcaggtcctggacatcctctcctaagttcttgcaccctacctcacagaacataagcaaatcccctgacttcccagaaagcctacgtcctgcttcttgagtcagcacctgcttcggccctgccttctcaatgcccctgagaaggctctggaccagttcagtaccctggcaaaactatggaagcatggagagtaataagagctaagctagattctgtgtcttgtatggcttggtattgactacctcataggcaactcacgaatgaaacactgacagacgctgaagacataacagatacacatacagaaaagctggaatggggtgggctttgctcactctaatggggaggagacacccatgaactactgggaaattcagccagttaactatgttcagcacaaggagaagattagtacagtgagtacaggcagtgggctgaggggagctctgcagtcaggctatctacggaggatgtgtctttcaaatatgctcattttattcgcataaacattccttacaataccatgctaatagaaatgttagacagacagacatctcaccaggcagggaccagttagtgggtcagaaaatgctgctgcagtgttccactggggagtcttcagaagcactgcaggctcaattcatgactgcagttacgtccttcagctgtgacaggcccagagagatggcactggtggcggtccagaagattccttgcaagtgtcagccagcagcaggcgtgtgtgagctcaacatggtgcaaaaagttcaaaagtcactgaagccagggccacaccagaattcagtctcaaagtcctcttgctgatgggtatcaatgcagaggctagagaagcactgaagaaaagcggtgctgtcctaaaggccagatccaaagatccaatttttatcgtatttcattgagcaacagctttgctgtattggggctcacagcttagggctgatacactaacatattaatggcaccctgaggttagttcattagcacaatcagtgcctattttgaacttggttgtatctgagctgccttgtaaccatcagaacttgccttaaatgggagagattagcccctctctaagctccctggtgacaactttctatgttacaggaagtgcattattagtctaagtcacacaaaatggttttactcgtgttcacaacagttacatgtctaggtgggaggtaaggatacagcctctggctataaacatatggaagaaggaagctgtgatacatactttctgtacattggttatattactcagggttctctagaaaaacaaaactgagagaattcagcatccaaaagcagacatggtgctgaagaagtagctgagagttctacatccagatccacaggcaaaaggaagagagacactgggattggctcaaggttttgaaacccagaaacccaccccaataaggccacgcctactccaactaggccacacctcctaaaccttctcaagtaatgtaactccctaatgaccaagcatccaaatgtatgagtctatagaggccattcttattccaaccaccactctgtcttccaggctcttttcaaactgaagattaacactccaaaaacagcttcttgtgctttgctgcctcaattctcattcctcagatcatcatcactgcaaactaatttccaggaccttccttggctcaaggatcaccataaggccttttgtctaggcttgttattggagcaaagcaaagaagctcatgtggtatcatcttgaataaaaatgttccctataggctcatatatgtgaatgcttcgtcatcaggaagtggcactatttgagaaggattagatagattaggaggtgtggccttgttggaggaagtgtgtcgctgttggatgggtgttgagatttcaaaagcacatgattctctttttcctcttacagatcaggttgtaagtctcagctactgctccagtgcctacctgtatgccaacttgctccctgccatgatcataatgggctaagtctctgaaactataagcaagcccccaattaaatgtttttctttatgagttgtcttatgagtcatagtgtctctttaaagcaatacatcactggctagtatagctcattttctttttctctactctattttgttttctattttctattttcttttttgaaaaaagaattattttcttattttatttatatgagtacactgtagctgtcttcagacacagcagacaagagcatcagatcccattacagatggttgtgagccaccatgtggttgccaggaattgaactcaggacctctgaaagagcagttggtgctcttaaccactgaaccctctctctagacctctcttttctattttcaagaacaaggtttctctgtgtagccctggccattctggaacttgctttgtagaccaggctgtcctcaaactcagagatctgcccacctctatctccccagtactaagatcaaagcttgtgccttcacacctgctttaagaagcttattttcaaaagaattactattatatattttccacctggtagcatgcattccttaagtctcctatcctcccacatcttccttaatgctagaatttatatttcccatacaaactcagatgcacccagaagggtaacccaactccatagggaatttttgtgagtttatagttgggggcccatctacacagagattatcacaacctctacccatccatgaaacctttctactccctaaccagagcacatagggttgatttgtattctctaggcttctatcatttctctcacttgttcacagatttatgagaccagaaatatgggagaaaaatataaagtagcccactcttagactctgagtaggtgtacgagaaatgtccctaaaagagaacttcagctgggcggtggtggcacatgcctttaatcccagcacttgggagtcaaagacaggtgaatttctgagtttgaagccagcctggtctacagagtgtattccaggacagccagggctatacagagaaaccctgcctggaaagagagagaaagggagggagggagggaggggggagggagggagggagagagagagagagagagagagagagagagagagagagagagagagagagagagaacttcagcccttatacttttaagctgatatgaatgccttgtaggatccattcctgtgactctcccaggcttggattggctccctatgttcattttctttgcttacaggaacagttccttaacttttttccttcctcccatcttgtgttagagttcaatatgttaggttcttatggacttctagaattttcttttgcagatatatatgttaagatacaagtgatccacaccttactctaattaaaatagccctacttatatctgatgctgcctctattttcttgaatctggctctacctgtcctccctctccctgccacagatggaatttttgtggtggaatgaagagtcagatgtgttccaagggtttacgctgatctgtatagaactggcttaaaaaactgatctaggcaagcagattctttcttcctttaatctaaagtatgaagcataaaatgacaatagcaggcaagtggtgaattattacaactgaaaggcctcaaggtataggtaaagtaaatgacataccggaagatttatgtggaacaagtcattaaagtaattagaggcaggaaagtgatagacgggtggaaagaagcaggcattaaaagtgcagtctccagaatgatggccttgaacacctgctgtatgtctctagggtcacactgaagcccaaattctcccccatgtgagtcttgttggggtccattccttctacagatttttattgctgttatctggttggttgattggttggttggttggctggctggctggctggctgtttggttggttggttggtttgaggcagagtcttcctctaactcaggctgatctggaactcactctatagcccagtttaacttcaaactcaccacaattctcctacctctgcttttctagcattggaattacaaatgtgaggcaccattgggattctggtacagttttcttcttggacttctttcccactccctgaatatagtttatatacccatagtctgaggataaacttcactttagatgttagcttgagtggattccttgaaactagctgaattgaagtatattccttgcagtttcttcaatttctgatggagtagaatgaaatattctagcttagataaatcaacaaaatacaaatgtgggcttcttttccagtaaaacttatgctgccctttaataggtatgatttgcaagcacagttgtaatgtttacatggacattctgcctgagacagagaaaagaaattcagaactccgatatactgcagcatctttctacatgggaatttagggtctgctgtggctatagaaagacactcagccaaatcttgttgatacacatatgggagggcagggtggtctcacagaaatggttagatgaggccatcactgaccttaaagctcttgattctactagctatatcaccacctccggctagtatggctgctttgtctgacctcctagtaaataaactggttcctgatttgctgctttggactgctctgggctatgtctagggctttctacctcacctctctttcatctcaatgacttgcctctccacttctctgaatttacatgcctccgactgcctgtcttacttgccttcagtactcttaatgtctttcttctgtctacctttccctggctaaaaagcaaatccatgcaccacaaagcaattagcctatcatgaaaccttgagttttgatgaactaagccagagttcctgaccctaccctctctgagctccctgagcttttgcagggtttctagtaaatatgtccttttcaccagctatgttgaatctggaactctctgtcttgccacttgatctatggaagccttcgaattcatcttaaatacatatataaatcatctactgctgcagaatgggaatgaataccagctactggcgctgacttgtgacttggcctcagctcaatccctggggtgctggcaacagtaactaaatgaacagcagcttgctagccagtggaaagaaagggcttgaagcaatatagagggcttttctgggcattgtctgaacagaatacaaaagataaattcaaggaagttggtccaaaggcataggcatgatggtcacctaaaagtgaccaccatcattcttcaactacagtgtaacagaagttcttgtttgcttggttttttaaaaatatttatttatttattacatgtaaatacactgtagctgtctcccgacacaccagaagagggcgtcagatctcattaaagatggttgtgagccaccatgtgatttgaactcaggaccttcagaagagcagtcagtgctcttaaccactatgccatctctccagcctctgcttgtttctttttgttggaggcagagtttgactgtgcattttagaatggctttaaaatcacagtgtagcccaggattgcctcaagtgctgagattgcaggcatacacagctacattgggctttaaagagagaattttacaactgaaggctgtctcacaaaccctaaggttaagcatgttgatggaccctgagaatagactagagcaggcagttacgatattttcagaagctcagacaatggacaccctcccataagtcttcattgtatttggctctttgcttccttctctataaaaagcaccttcctttgctcctgagaacacacagagaaatcagcttccccatactgacagcactgccctcactattgtctactgcctaagactcagccccagcacagaacctctccaaggaaaatgctgctaaagacgatattctcttccctccagcccaaaacaggatttctttttgtagccctggatgtcctgaccaggctagcctggaactcaccgagatctgactgcctctgcctcttgggtgctgggactaacacaatttggaaagggggtgtgatatagaaagagaagttgaaagttacgtttgtggggccggagcaagcaggcctgagcgagaactggagagttagctaggcagttaagagcactggttactcatctagaggtcatgagttcaattcccagcaaccacatggtggctcacaaccatctgtaatgggatctgactccctcttctggagtgtctaaagacagctacagtgtacttacttacatatattaaataaatctttaagaagaagaaagaaagatacgttcacaacatgagtagttgtacctatctttttttttaaggttttatttatttattatatgtaagtacactgtagctgtctttagatctcattacggatggttgtgagccaccatgtggttgctggaacttgaactcaggacctccggaagagcaatcagtgctcttaacctctgagccatctcaccagcccaaccccatacccatctttaaaggcaagatgatcaggactttcaggctagcttggaatacatagtgagtctcaatctacacatggtaggtggctctctcaacactacaaagaccctcctcttagaagaaaggcaatgggaaacaggaggcggtttaaggagtcaagtgaagtgcagttgctctaacagggattcacccaatggccaagcaatttttcttcagaaccagtgggcatgaatcttaggacaagtcccaaaaggccctgtttccttattgaatgctcttatctttcagttctataagagggagaacaaataggagactaaaaaggaagaagcggtaaaatcaagtaaggggtagcagcccagttagggtgttcaattgaaccaaaacacgaccaggcctatcatatagtaagtacacaaaaactgttagctattgttatggacaccggggaaggctgagtgcagttggattctaagttacagagattggataacctttgcaaatggttactggaaacataaaggaacctgggcaaggttcccactttgtaccagaatatgtgtccctaggaaccaagactcaggtctgccacacacaacactattctcctatggcacaagaaaataacactaacacattcttggatttggaccctactttttcaagattccttgcaacctctccttttgttatgacaacacagcacttacttcatcctcattacagctgaactgagatagctctccctgcccccagtgaattgctgaatcccactgcagttgtttgtacttcaggactggcctggccgagctcaggcagatcctgttaggactgtgctgagaggatatgcagtctctctagaactcgagggaaatgctcgaggaacactacttttttaaagatgtagtcattttttattttatgtgtttggctgtttcgcctgcatgtatgtatgtgtgctatgtgtgtctgatgctcgtggaggcgagaagaaggtgtcacaccctctggaactacagttacagagagttgtgaggcaccgtgtgggtgctttgaactctgtaagagcagggagtgctcttcaccacagaatcatccctccagtatcccaagtaacatcattataatacacattacaaattagctgctgcttcttcctcggcgctgcctacgaggtggctgccatctgttttacggcatcatggctgccctccggcctctggtgaagcccaagatcgtcaaaaagaggaccaagaagttcatcaggcaccagtcagaccgatatgtgaaaattaagcgaaactggcggaaacccagaggcattgacaacagggtgcggagaaggttcaagggccagatcctgatgcccaacatcggttatgggagcaacaagaaaaccaagcacatgctgcccagcggcttccgcaagttcctggtccacaatgtcaaggagctggaggtgctgctgatgtgcaacaaatcttactgtgctgagattgctcacaatgtgtcctctaagaaccgaaaagccattgtagaaagagcagcacagctggccatcagagtcaccaatcccaacgccaggctacgcagcgaagaaaatgaatagatggcttgtgtgcatgttttatgtttaaataaaatcacaaaacctgcaaaaaaaaaaaaaaaaaaaaaaaaaacaaattagctgcttttttttcataatccccattgcctcttgattattttccttttgaggtttgagacaagctctcactgtacatgtcaaactcataaagatgccgttgactctgcctcccgagtgccgtgattaaaggcatgtgccaccaccgcctatcaagggtcattttcaaaagctccacttggaaaatctatgtcatacgtaatgataaggcaagtgcaaggtcacagaggtttccacctcaagcttcaaagagaatcctgagagaccaagtgatgcaaagcaagatcagaatccctagggccatttttgagagagcagtgtttgcagctatgggtgaaactgaagatgaagtagcgcctcgaagacattgaagatgccaggaattcggagtgtctgcccagagaagccacaaccagcgaccacagccaacccaggagaaaggccatataagctgcagtttgctatagaggtgggactgtcaagctctatgaagctcacatcatgccaatgtgctccaagatgtaggacataaagcttagggctctgccgggctttgggctctgggcttgttttgctcccgtcctttctatgcctctgttccttttttcaagcatacttaattcacattattcttcttatattaaaaacctttacatgagctggccacagtggtgcatgtctttaatcccagcacttgggggggcagaggtaggcagatgtctctgagttcgagaccagcctgatctacatagtgagctccaccaagacagctagaggtatataatgagaacctgtctcaaaaacaaacaaacaaaacaacaacaacaaaagaaaaacaaaaaaaccttaagtggtagctacagctggagcctgggttctctgaacgaactctttgatatgggttttcacaagacagacggtgaattcctgatacagaaactttatgaaccaattttctttccagaagttgggagtcaagtaactgtaggtcttggagatggcatcaaaggtggccttgacaaagttgcccagggtagtattgtggcccctggctgatgtgtggcagtcagcaataccagccatcagcatcagctttttgggcacaggagcagagacaatgtcagtgcctctggtaacagggatgaggcacactagtacagagtcccagcggcctatcaccttgcatggaacggtttagggattgacaatcttgttcctccagtaccctaatcctcccagggatggtggaaagcttgaccaagattatggcccctcagatagcagtgcctaccaccttggattatctaacaccaagaccaatatgagcattgtagtcccaggcctgttggcgagtcaagtctgctacttcattgacatgatctttagaatcatatctttgagggatactcctaagaaaaagtcaataatctcggattccttaatgagcagggagaacaggtaggtctcctccaggaacttgatcctttcattcttgaccaagtggcacagcttgatgatgaggatgcatgtcttgcctccggatttacctctaggagcctagcagcctctagcatgtcagaggcagttgaatccattggaaatacaaaatttttctttccaattgtataggggctcacagctaagggtttgacatgagtctcagaagaactttggacttgaacttctgaacaggatcagagttgtgagttgcaaaactttgggcaattttggaaatggtctaaatccattttctcttatgagatgaatggacatcagccattgagggtctagaggtggctctgatgtaatcagtggaataacccactaatggagtcataacttgatggcattattagaagatgacagaaggtttaggaagagaggcctaattggaggaagtaggttactgaaaacatgtccttgaggaatgcatattgtccgtctctgcctgcttccttgccaccatgagatatgcagctatgctcctcacatgtacctctactctgaagctatgccttgcttgggattgaaaagtaccatggacttctacaactttgagccaaaataaacctgtcctcctttgaaagtgttggccatactgacaaacagtgattaccacagagcctttgtcaaacccctgcaggtgagtgacagtgaaggacctaaggacttcagaacattacttccaccagctatggagaactactttccttttgataagcagccaggaccttgcatgtgctcagtaaaacactagagctatagccccagccatgtttttactttttgagttagggtctcaccaagtttcctaggctggctttgtacttgctctgtagcaaccagaaggccttgaacttgtaatcctcctgattctgattcccaagtagctggaattaaaggaccatgccaccaagcctggctcataaacagctttatcgttatttattgtgttgttgttgttgttgttgttgttgttgttgttgttgttgttgttgttgttgttgtttgggtggttcattggttttggtggttggttggttggttggttggttgattggttggttgggtttggtcagtctcaacccagcctactaaaacttgttatgaagcccaggctagccttgaactagcaacagttttttacttcagctgcccaactactgagattacaggtataaatcaatatgctcagcaatgaactggctttaaaaagttatttagatcttactagagactctaacacttagccatgggccacttgaggtgacctgtaacataagttgctcatcatgaactcagtgttatctggcccatttggctataactgtgcatacacaaaaaccttccattgtcaaaaagcaacagtacactcacaatcaggtgagtttttcccctttggtttattctctacagaaaaaccttcacagacacacctagaggggttcctcatcatctcctaaatgagatggggttctaaacccatttgagttgatgatgattaaccacaagtctatattttggcaacttggcacaattcgacatcattttaaagcatatccttctacccagcccacccccaaaagtttatgtccatctccagtgtgaagtgtacttagtatatctccatgaattcccatagttttaaatgttgttcaaagaccaaattcaaggcaggtgtggtgtctggtgcctgtaattccagcacataggagactgagacaagtgattactgcaagtccaaggttaaaatgggctacaaagtgagttcctggtcagtttgagctacacaaagagaccctctatttaaaaaaaaaacttaaaaatcctctgcaccccaccatgcctctaggggcaggcagggaaagatgccgagagacctgccctctgccacagagcacagactggctgtagacatacagaaaaggtgtgaaagatataagatgttcacagacccacccactgccatgtcacaccttgactctagacacctagaggtcggcttaaccccataccactcagtatggacagaggatgtcacccagaggctcgccagccatgtagtcctcctgcactgggaaccactgcaatgtgcaagtatgtggtagacagatgagcattttgaatggagacaggaaggaggagaggaattgcctgctgtgagtagccaaccctactacctgaggtcatggtgctttaagtcccagcccaagctgctgcactggcagatttgatgtccatagctcatattactactagagaccatgggaatgccccttgtctgggcagccgtctgggaccacatagatgtccaagggctatgcagaactggtcctgaatctcagtggcaccgcttgctccacctcccactggtgacagcactcgggagctagccctgatattgtgggcacatgtgagccacccctgagggcatgagtgtaggaaagctgacctggacagtctgccttgaggtgatacaagcacagaggtgatgtcctaccccccccccccccccccacacacacacctcggcccttaccacctctggcagtcagcagtttgggggcggggagaagctggctccaggatcatgaaagcaggaaagctggccctgccccttcaccgactgtagcacccaggagatcaggccctgcacctctcttgggtaagacagtggagctggctctgaaggcaaaggcctatgtgagccaagcccaagagtgtgagagcagaagagctggcccagcccctcacaggctgaagcacttcggagaatgggcctcacacctcagctgggcagcacagtagagctggctctggaggcatgggtgcagggaaagatgacctgagagcatgagagtaggagagctgaccctgccttctgccaatggtgacattgggtgacatgggcagagcagtgctggagagcttgccttggtggtgtgggtaagggagagcaggaggactgatgggctcagctaccacccaggcccagatccggagctttgagttggctcaccccaaccaacatcgacatcattggttgtccatgctgtgccactatagagcatcgtgtcagggccagctctcccacactcacgccctcagggccggttcacctggactacaccaccagagatttcgaaccagaccaatgactcattgcaatgaacatatgcaagtgaagatgtgaggacagaggggtttgctgagggacacactgacacacgacagcttccacgacaaaatgttttctatgttttgttttgtttagtgtgtgtgtgtgtgtgtgtgtgtgtgtgtgtgtctgtgttatttgttgaggagggtttgcaagggcaaagggtgaatacagagaaatggggagatgagtgggattgggtgtgtaatgtgaaactcacaaagaattaataaaagtttttcttttaatcctctgaaaagaatgagggctcacagagactgaaccaccaaccagtgagtatacatgcacggacggtctggacctaggtcccctctacacatttgtagcagatgtccagcttggtcttcatgtgggtgtgctaacaactggagtaggggctatctcagattctattgcatgccattggatccccttgccctaccaggactgcctgggcagtagaagaggatgtgcctagtcctgatgggactagatgtcccaggatagagtgatacccaggggggcttcccttctctgagtgatattatgaggcttttctggcagcaactctaaaggaaaaatacttggctcttgggtaaccctaaaccttcacttcatgtcttggtctttttctcatttatcaggaaagagccaatccccagtttttcaattcttctcttgagtctttattctggtgcatcttcaaaaggatgtcacagtgtcccacaaatttgccattgaggtacccctttcaggatggtagtccagttggagtagtctttgatgccttgctgcaccttaggtggtccagcatactattaagccacatagacaccaacactgtgcagcaagaggatctccaccactatgttgccaaactagaacttgggggtctccttaaggaaggtcaaccacccactgtctttcttcaccagcacaaagtgtggcacccggatcctgagctctccacagcggagtcacctcaggacatcagacttgctagtctctacctgcttggtgagtcatcctcccagcacttgtagctacagacttcctcttgaggttgctttccttggatcctgtaggttttctttgggtgcgttttcatttccattctattctaggaattttaaattttccttcttgacctcttcagtgacccttcactgaatagcaagtcactcaatctttgagcttgtgtgtctgtcatttctacttttattccactgtggttggatggcatacaaaaattcatttcaattgctctatagttgttaaaacctgttttgtgtcctattatatgagtatgtatttaattattgagataaggtgtccctatgtagccctggctgacctggaacttgcagcatagaccaagctagcctcaaactcacagagatccaaatgctggaattaaaggctagcacttgccacaccacacctgatctattttagaaagagcttcataggctgctgaaaagaatggatattcagccatgtttggatggattgttctagagaaatcagttaggtccatttgacctaggatgtctttttgttgggttttttttttaagattttatttatttcatgtatatgacgaggacactgtagcattcttcagaaacaccagaaaagggtgtcagatctcattacagatggttgtgagccaccatgtgattgctgggatttgaactcaggacctttggaagagcagtcagtgctcttgcccactgagccatctttccagcccctaggatgtcatttaactcagatattcctgttatttttctgtcttcatgaccaatgtattgttaagtataaagaactgaagtcatggaacagaaggggatggcaacctcacaagaagaccaacagtgtcagctaatctggaatcctggcagctcccagagactgagccaccaaccaaagaacatatgtgggttggtctgaggccccagctcatatatagccttgtagggcctccgtgggagaggatgtgcctaatactgtagagacttgatgcccgagggaggagggatgctggagggaacacccttttagaggtgaaggagaaatggatggagaagaactctgcaagggaggactggaagggggcaacatttgggaggtaaataagtaaaataattaattttttttaaacaaggaggaaaaaacgaaagaagaactgaagtcacaatgggcacagtggctctctggaggcagaagcagatggatctctgcgaattccaggccagcctggtctacagaactagttccaggacagccagggctacacagagaaaccctgtcgcctgtctcaacacccactccaataaagagagaaagctgaagtcacttactgttactgcattggggatactttggatttgtcttatgttgtttatgagattgggtgaatctgtgcttggtggatatatattttaaattgtcatggtctactcaagaacggttctcctaatcaataaaaaatgaccttcatctgataactagttttactttgaaatctattttgtcaaatattagaagagcggcacgtgcttgtttcctgcttccatttcttggccttttaaggttgcatctgtctttaatggtgaaatgaatttctttttttttaaagatttatttatttattatatgtaagtacactgtagctgtcttcagacacaccagaagagggaatcagatcttgttacagatagttgtgagccaccatgtggttgctgggatttgaactaaggacctttggaagagcagtcgggtactcttacctgctgagccatcttaccagcccctaaaatgcatttcttagaggcaagagatggatcttgtttcatttcattttatatataagggtgttttgcttacatgtatgtctgccgcaccatatgtgtgcctgatacccaaggaggtcagaagaaggcatcagatgctctgcaactggagttagagatcattgtcagcgaccatatggatgctagatcgagccccagaatctatttgtttgtttgtttgtttttatctatttatttttcttcttttttatgttttgttttgttttgttttgttgaaacggggtttctctgtgtagccctggatgccctagaactcactctgtaggtccggctggcctcgaattcacagagacttgtctgcctctgactccacctccacctctgcctccctagtgctgggatcagaggtatgccccactgcccagctacccttattttttcaactgaagtagttacaatgttcaaaagaattgaggttgcagtagcagaattgaaatgccatttttctctgcaagactgtttttagggcaccaggctcagtgtctaatactcccttaatataaaatagtgcccccccccatgaataatcactataaaagaataggcctgccgggcaatggtggcacatgcctttaatcccagcacttgggaggcagaggtggacaaatttctgagttcgaggccactctggtctacagagtgagttccaggacagccaggtttatacagagaaactgtgtctcagaaaaccaaaaaccaaaaacaaacaaaaaaagaataggcctaatacaaatttacaataattggaaaagcaaacagggctggagagatggctcagtggttaagagcattggctgcttgctgttccagaggtcctgagttcaattcccagcaaccacatggtggctcacaaccatctgtaatgagatctgatgccctttctggtgtgtctagacagctacagtgtactcatatacaataaataataaataaataaataaataaatagatagatagatagatagataaataaataaatttttaaaaaggacaaaaacagccaggcaaggtggcacaggcctttaatcccaacactcaggaggtagaggcaggcagtttgaggtcagcctggtctacaaagtgagttccaggacagccagggctatacagagaaaccctgtcttggaaaaacaaaacaaaacaataaaacaaagaagagaaaaagaaaagaaaagaaaagaaaagaaaagaaaagaaaagaaaagaaaagaaaagaaaagaaagaaggaaggaaggagagaaagaaagaaagaaagaaagaaagaaagaaagaaagaaagaaagaaagaaagaaagaaagaaagaaagaaagaaagaaagaaagttagtttccaggtatggtgggacaccccttcaatcgcagcactcaagtcagagggaggtggatgaaggtgtagagtctgcttcattgctgattgtagtctgaactctgacaacattcctgaggatgttggagccctcttacacccctgtatgctcctttgtgaggtttcttcacagatgctcgtcccatcaatgggttgtgtcacagatgcaggtcacatctgctggcagtccttcaggagtcttgttgtgaatgttggcgccacctctggaaaacaggcactccatttataatctgtatctgtgttctcatgaaaactctgactctgatcaagtcttcgccttactaaatactgtttgagctgggcagtggtggcacacgtctttaatttcagcacttgggaggcagaggcaggtggatttctgagttcgaggccagcctggtctacagagtgagtttcagggcagccagagctacacagagaaaccctgtctcgaaaaaccaaattataaataaataaataaataaataaataaataaataaataaataaatactgtttggactcggaatttcttcctccaaagtggagtggaattctgctggccctgtgtctgcttgtcgtcccatgacatttgctctggccactgactttgaaagggtctctgtaaaatggcatcctgtggcagttccagtcaagtgccaagagaagacaattcttctgagtctcagctgtagctctgtacaacttttgtctcctttccccctttttatttatctttaaaatgtctgttactgagaatccagggctgattttttccaaagttctctccctctctcggtgggtaaacctccctagatcacaccaacccctccctgacagctctcctttctttatatgggtttgcttttgtaggccccaggtgctccttgaagtttttcatatattttctccttcattctgcacttctgcgagctgacccctgatatggtgtgcagaggctcttctgtggtcacgactgtgctactgaatgacttctgtacctggatggccatgtccttccgaagtttgggaaattccctgctattatttcagcaaaaagatggttttctccatagttttagttttgtcaacatgtcccatggatcagatatgttctgttcataatttttttcttgaagtgtctgaatgatgtcatcaagcgctgatagtctttcttttgagcttctagtctattagatatagggctttcgaatgactttcttatttgatttaatgagctttacattttgaagatttgcttccttttttcagaacctttatccatttatcgaattcttcttttatatcctatattgtttcccttaattcattcagctgattattttcttgttttcctttttatttacttattagtatgtgtatgtatttgtgacagagagacagacaggcaggcaggagacagataggagagaggaagagggagggagagagggagagaaggagggagggagggagggagggagggagggagggagggagggagggagggagggagggagggagggagagaatatgcatgtagtggtcagaggccatctttgaggagtcaggtctctccttccaggggtctgaggactgaattgaggttgtcagacttgagcaataagggccactgctgcttcatttcattttgttgtgatcttatctgctttcagcattagagtaactctggtcttttttgtttgtttgtgcttgtttttgttttttcaaggcagggtttctctgtgtagccctagctgtcctggaacttactctgtagaccaggctggcctcgaactcagaaatccgcctgcctctgcctcccaagtgctgagattaaaggcatgtgccaccactgccctgctgtaattctggtcttataagtatagaataattctctctttcagaacattgcaataatttcagaagtgttcatccttcaaatatttgttagaatattatctttcctaggcttctctttgatgggagattttttaatacaaatcaaattcacttgtttgttattgttctgtttatgtctcccccacccccatcatttccaaaatttggggaaatgtctgacattatcttattcctagaacagaactaaacattctctaccagtttatggtcagtttatagtcccttcttttgtccattatgtgggtaatgattttctgaatgtgcttaatacttgtgagcatatgttcattcatgtctgtttgaaagattgggttccacttaaaaaattatttgcagtctagctttgtttcttactttccttccatagagtccaagcaagcctcatgatgtttttcaagcctccggtcattgctactctttcttcactagatggcaacctaaactcaagtttcctgtgggtcagcatccaaggcaaactcggaagtttggtcaaagggtgtgcctcactctgctgagtcagaattcaacccctaggccatctctttcacctaattacctgcccttactcagagaggacaataactctctttatactgtactacctggtgttggggaagaaatgaagtcccaaaaagactttgatggatcatatgaaaagctatagccagtgctcttagctcaggggctaagagcactcattcaattcttgatgctcacaaaatagctcatacccatctgtaattccagttaaagtggattcaatgtcctgttatagtttctgtgggtctcaggcacacatgtgtacaatcacatatccagacaccccagaaaaaccatacacaaaatattagtgagacctgccaaccaccaagatagatagatagatagatagatagatagatagatagatagatagatagatagatagatagatagataaaataaaaaattatagccaggtgtgatggcacacacctttagtaaacagcccttgggaagcagaggcagatggaactctgtgagtttgaggccaaactgccagcctggtctacataagggagttcaggatagccagggttttgtaacacagagaaactctgtctcaacaaaacaaaacaaaacaaaacaaaacaaaacaaaacaaaacaaaacaaaacaaaacaaaacaaagcaaagcaaagcaaagcaaagcaaagcaaagcaaaagccaggaccagcatggggacaagaccaagttgtttgtggcctggtgatcctccagttgaccagtgatgatataaagcaagctcatcacaccctggctaagaatcatttcctgacagcagggtacgatccagaggttctatcacaggcaccaacatagaatcttggaggccagtctctgtcttggggtttcactatgactggtttgacctgtcatgcatttgaaacctgtatttgatcctcccctgactcttggtaaccagtagagagagctgtctgtatgctatgggggaattaggtgacggatactttcttggctgacagactgacaatgaagtggatatcacctaaaacttatatccataaagaccagtacagccccgagacagacacctgggccatgctacagccagtagtggactgagtctagaaatttatcctgttggggtttcggggtctgctaggaatatggaagtagagaccaaatcagtggccacaagtctggagtcagagaccataagattctgccctgtactagacatagccacagtgagcccatagattttccttccacaactacttggttctcaatcctgaactgcttgtagttggtgaagggaagtcgtagtctgtgcaactgtgtcattcccactttcttcaatttctcccagttgccccaggtcttcagaagaaagtattattatgctttaaaaagttatttaaattggtgtttttgtgaggagcctgacactggaagattttatttcaacatgttgttctacctttcaacaacaataacaaaaaaaacttttcaacaataattatattcaaggtgtctgtttgtctgtctatctgtctgtctgggagagtctatgtgtgcctgatcctgtgcctgccctgcatgaatttgccacacatctctcagcgaagttagaactcactgactcagctagcttggctggccagcaagggtcaggattcctcctgtctccatcaccctctgcactgggactgcaagagcataccacctcacccagatttcttttgttttgttttatttttttgagataaagtttctctgtgtagccctagctgtcacctgacatttttaatgaatgatggggattgaactcaggtccctgtgcttgtgtggcaagcacttttcaaaccaagccatctcctcagctcaattatgctcttttaatgtctacttaagcctatgaaaagagctcactgatagaacacatgctaagtctataaaaggccctggatttaattctcagcaccaaaaactagaaatatgcatctactgaaaagtttctcaatagtggtgaagacagacaaatgcccaagacactgttgctctttacctgccacacaatattttattttatttgttattgttgttattttgtttgtttgtttgtttgtttgttttttctcgggacagacgcttggcgccagaagcgagagcccctcagggctacacgcacaacacacacacacacacacacacacacacacacacacacacacacacctccacctcaccgggtcagtgaaaaaaaacgatgagagtagtggtatttcaccagcggccttgttttgtttttgagacaagatgtctctatgtagcgttggctgtcctagaacacattaagtagaccaggctggcctgaactcacagagatctgcctgcctctgcctcccgagtgctgagatttaaggcatatgcaactacacctcactgtggtactgctgatgctgttattattactattattattattattattattattgaaatataactacatcatttccccttccctttcatcctccaactcgttctatatcctctcttgcttcctccaaattcatagcatctttttctttgattattattgttatatacatacacagacacagataaacacaaacacacacacacataaatgcacaactataaaaagagaatattttattttatttatttattttggtttttttcgagacagggtttctctgtgtaatcctggctgtcctggaactcactctgtagaccaggctggcctcaaactcagaaatctgcctgcctctgcctcccaagtgctgggattaaaggcgtgcgccgccacgcccggcaagagaatattttaaatacaagtagatttctataataaaataagattttatcctaataataaaaggtgacatgtaagaacaaaattaaaaaacaacaaaaaaccctaaaatccatgtcacaaaagtccaagtaagttatgtaaagtttgtggagaatgagatttaaggatgacatatgtttaattgaataaggttattataattcttgaggttatattgatatactcacagtaaaatctacaataacttgttataaaaatcaaccatggtcttagttagggttttactgctgcgaacagacaccatgaccaaagctactcttataaggacaatgtttaattggaactggcttacaggttcagaggttgagtccattataatcaaggcgggaacatggcagcattcagacaggcatggtgcaggaggagctaagagatctaagtcttcatctgcaggcatctaagagaagactggcttccaggcagctaggaatagagtattaaaggtcacacccacagtgacacacctactctaacaaggccacacctactccaataaggccaccactcctaatagtgccactccctggcccaagcatattcaaaccatcacaaccacatatgtctagttaagataattatttatgggactagaaagatggctcagcaataaagagcacttgtgggctggcgagatggcttcatgggtaagagcactgactgctcttccgaaggtcccgagttcaaatctcgccaaccacatggtagctcacaaccacccgtaatgagatctgatgccctcttctggtgtgtctgaagacaactacagtgtacttatatataataaataaataaatatttttttaaaaagaaaaattcacttcttatttaaagaaaaaaaaaaaaaagaaagaaaaaggagcacttattctttccagaaaacccagattcaattctcagcacccacatggtggcttacaatcatcttggacttcaatttcagtggataggacagtttcttttggcctacacaggcactaggcacacaaatagtgcccatgaatgcatgcagaaaaaatatccatagctataaaataaaaatagttttattttaaaaagacaattacttatggttttgctaactttgtttggttttaatgacttaaaaaagcttcgtcttaacaataatgacaataatatcaggtttactttaaattaattttgtttgttgtcaagccttatttaaacactacccaaaagttaaaatactggtaaatctgttcttttaagtgctcttcaaccacagcttgggggcctccacctatgaggatgagggcgtcaaaaaatacagccaatattttggctctgactttccaagttctgccaggaaccaggacatgatagggcccttcttgtaaaacacttatcttctcttgctgctactacaggcacaatgccaaggcctagagccactttcatgtgatgaatctgacccaagttgctaaatttttattaccttcttggaccaggcccaccctggagatgctgttccatgccaggcccaactgggaactgtgccatgggactttgttagatttcagccaaccaatttcatacttcctattaccacccctaggacatattggtttgcaatcaccacaatctctgcaaccactaatcagcactgagtatctggaggattgacctgcttcctcctccaacctgacctgaaatcaaccaagtttgtgcaagagcagaaagaagtaagcttctgaccaatatagcacagctggaatctcatagcagacacacaaataacaaaataaatccacatgccaagacctaacacaaaacccaagcagtatgaaagaccaagaaagtatgcccctcaaacagaccagcagtcctatagaaatgttctccattggaaattactggatgaatctcaaggtacaagaactcaagaaggtggactccagaaaatcaaataaccccattaaaaactggggctcagagctaaacaaagaattctcatcggaggaataccgaatggctgataagcacctgaaaaaaatgttcagcatccttaatcatcagggaaatgcaaatcaaaacaaccttgagattccacctcataccagtcagaatggctaagatcaaaaattcaggtgacagcagatgctgttgaggatgtggagaaagaagaacactcctccattgttggtgggattgcaagcttgtacaaccactctggaaatcagtctggcggttcctcagaaaatggacatagtactaccggaggatcctgcaatacctctcctggacatatatccagaagatgttccaactggtaagaaagacacatgctccactatgttcatagcaaccttatttataatagccagaagctggaaagaacccagatgcccctcaacagaggaatggatacagaaaatgtggtacatttacacaatagagtactactcagctattaaaaagaatggatttatgaaattcctaggcaaatggatggacctggagggcatcatcctgagtgaggtaacccaatcacaaaagaactcacatgatatgtactcactgataagtggatattagcccagaaacttagaatacccaagatacaagatacaattttcaaaacacatgaaattcaagaagaatgaataccaaagtgtggacactttgccccttcttagaattgggaacaaaacacccatggaaggagttacagaggcaaaatttggagctgagatgaaaggatggcctatctagagactgtcatacccggggatccatcccataatcagcctccaaatgctgacaccattgcatacactagcaagattttgctgaaaggacccagatatagctgtctcttgtgaggctacgccggggcctagcaaacacagaagtggatgctcacagtcagctattggatggatcacaggacccccaatgtagaagctagagaaagtacccaaggagctaaaggggtctgcaaccctataggtggaacaaaaatatgaactaaccagtacccctcagctcgtgtctctagctgcatatgtatcagaagctggactagtcagccatcattggaaagaggcccattggtcttgcaaactttatatgctttagcacaggggaacgccagggccaagaagtgggagtaggtgggtaggggagtcggggggagggtatgggggacttttgggatagcattggaaatgtaaatgaagaaaatacctaattaaaaaaatttttttaaatgtgacaaatttttaaacatacaaacagtagacagtaactttgcaagcccatgaaaagatcaaatctacaaactggagaaggaagaagagaagaaagaggagaagaaatgtcacagaagggaggacagaaagatcaggacaacttagatgcttatcctagaaacaacaaagatcttgtacccatgaactctcaacaagacctcctgcaccagaactgcaaagttcacaccaaccaacagtctaacacagatggaagaaagtttcacaagataccaacctctagatgaagagcaacaggcagtgtcttagttactgttctactgctatgaaaagaaatcatggccaaggtaactcttataaaagaaagcattgggctggagagatggctcagcagttaagagcactgactgctcttctgaaggtcctgagttcaaatctcagcaaccatatggtggctcacaaccatctgtaatgcgatctaaatccctcttctggtgtgtctgaagacagctacagtgtacttagatatcataataaagaaatcttaaaaaagaaaaaaagaaaaaaaaataaaagaaagcatttaattggggggctgtttacagctttacagggctagtccatggtcatgtgggaagcaaacaggaggcatggcacttgatcagtagcagagagctttacatcctaaaacagagagagacagagagacagagagagacagagagagagagagagagagagagagagagagagagagagagacagagacagagagagagagacagagagagagactgggtttggtgtaagctttcaaaacctcaaagctcatcccagtgacaagactcttccacacctcctctaacaaggccatgcctcctaatgcttcccaaataattccagtagggaccaaacattcaaatatatgaccttatgagagccattttcatttaaaccagcacaggcagtcaatggaggctaaaggagaaggaaaaataagaattggatgaaactctaattctaagagctcagccctaaatacataaggacaacactcatttgactcagattttatgtgagtatgagtgcttgtgtgtgtgtgtatgagagagagagaaagagagggggagagagagagagagagagagagagagagagagagagagagagagagagagagagatgggatggtggcatggggagggaaaatgatgtaaataccatgtattgatgtacaaaattctcaaataagtagaacaaaaaacattataaaagacacagttggaagaaagggattatggaagtttaaaatgtcaaatagactcaatatatacatcaacagagtaggaatttattaactattattgaaatacatattgaacgaggctattgtaagtcaagcctttaatcccagcacttgagagacagagccatgtggatctctgaatttgagaccagcctggtctacagatcaagttctaggacatccaaaatttcacagagaaaccttgtataaagaagacaaaaaaacaaaacaaagcaaaaatattatgttggacaattgactaaatattaaattgggcaaatataatgcaatatttgtgtctcatttaatacatagtaggagttataactatatatatttgaaatatggtctccttgtagtcttagctgtgctggagctcgctgtgtagaccaggctggcctcagactcacagaggtccacctgcctctgcctcacgagtgctgggactaaaggcatgagctactatgcctggctcttcatgtgaccaagatcacagcctgcctaatctacagttccagggacagtctgtcaagttccaggacagccaaggctatgtaaagagaccttatcttcaaaaaaattatatatacatatatatatatatgaaatcaaaaataaaacattcaaaataaagttaattcatacaactgaaaattttagattctaagtgaattcattactaaacccctacatttaagttgtgttctatcagtgtgttgacacttggtatagatttcttgttgtacttggaaggcttctgttgtgggcagtgaagtagaccctgagtaaatgtgtgttgttgacatgaacatggccatgtcacggaccccgatgcctctgacctatgaaagtgacaaagctttccctgggtgaggttcaaagggatagcaaagccttcttcttgtctaagtatgagtatttacaaaatatttaccagtctgtgtaaatactagtaaccacagcttcattccattccaggaagactgcagtcttagactttccttaatgttaaccctttgctccacctagaactttccaatggaaaacttatcttgctgtcttgaagatgtttcacctggctgtcttggaaagatttcaccagacaatttctgctgcttgttttgagtggccaatttaatagcatcatatatacatatatgtatacatatatatacatatatatatacacatacatacatacatacatatatatacatatatatttacattttctgttggtgggtttttttggttggttggttctgttttgttggtttcttgttttgttattttgtttatttgttttttagacagaatctctctatgtagttctggctgtcatgtaactcactatgtagaccaggttgccctggaacttacagagatctgcctgtgtctgcctcccaaatatgctagaattaaaggcgtgtatcaccatgcctggctttgtatttatttgtttaataaattcactcataaaaagccaaaaacaaaatgtcaaaaaacaaaaacaaaaacaaaacaaaaggccaaaaaatgagcggggcagtgatggcacatatctttaattccagcagtaggaagggagaggcaggtggatctctgagttcaaggccagcttgggctacagagtgaattccaggatggccagggctacacagagaaaccctgtctcaaagagagagagagagaaagagagagagagagagagagagagagagagagagagagagagagagagaaagaaagaaagaaagagagagagagagagagaaagagagagagagagagagagagagagagagaaagaaagaaagaaagaaagaaagaaagaaagaaagaaagaaagaaagagagagagagaaaggggaaggggaagggggaagggggaagggataggggaaaggaaactaggaaggccgatacatttgaaatgtaaataaataaaataaccaatagaacaaatttttaaaagaaagaaagaaaagaaaagaagagaaaagaaaagaaaagaaaagaaaagaaaagaaaagaaaaatgtggaaatcacagatcattctctgaaccatacattgtttggctcaattattacttttttaggatgtaactagggcttgcctaaaactcaagatcagtcttcttcagcctctcaagtgttgggatgacagatttctgtattttgcttttgctttctaaagaacattgtgtgtgtgtgtgtgtgtgtgtgtgtgtgtgtgtgtgtgtgtttgtgtgtgtgtgtgtactcgcacacattctttcaagtcttagctctaaggtgaccaaaaaaagaatagttgtgccaaaagggctgcattcgtgtgcagcaaatcagctgcacaagctctaccggatgagcacccaatggcaaagccattgcagggtttgcagagtgggaaaccgggaagagggaaaataaccaagaaacaaaagttcatcattcagaatattgtagaggccctgccatcagggacattgctaaagcaagtttcttcaatgtttatgttttccatgatcagtgttaagctgcgttgctgaaggagatgtgccattcatgttgaggcagtcaggaattgatctcatgaaactcagaaggactaaacattcctacctcctgttagtgctggtcaaaagcaggccaccgacgcaccgctccgaggacgaccagagattgttccagccctaagtcagcgccggatgtcctgacctcaagatgtaccctgataccgccaagttcctgcttccccgtgtaactgcctaaagaatgtgcaattgcctattgccccacccctcccgctgataagtacctgtacttccccttttgcttgtgcaattctactgccccattcttcctgctgaaaggcacttccccttttgcttgtgcatttaaaccttgggtctggctaatacattggaaccttgatgttactcagaatgtttccttgtcgttcttcacacaaggttctcgcctctctctaccccccaatttggttcttaggagaaggtcccctcgagaccctcgaataactggacctgctagacgggtcaggctacattcttagttccattttcttatctctttctttctttctttctttctttctttctttctttctttctttctttctttcttccttccttccttccttccttccttcctgtctgtctgtctgtctgtctgtctgtctcttcctcccttcctctctttctctctttctctctttctttctttctttctttctttctttctttctttctttctttctttctttctttctttttctttagacagagactcaaatagcccatgctggcctcacccttactatcagaggatgacctgggtcatcctggtcctctttcctctagttcctaagttctaagattgcaggcatgggccaccacacacagagatgacattctatattcatattttgctttcacaaatgtatatatacatttgtggtactcttgcctggcactgtgttcctcgctgccatgttccctagcacaataataatagactaagcctctgaaattataagcaagccccccagtaaatgttttcttttataagagttgactgggtcatggtgtctcttcacagcaatagaacagtgactaaaccagaagaaggtatcaggaaaacagagtattgtgcttaacaggcctaaccatgctgcttgttagtggaatatggactctggaactttgggctagaaatgaggttgaacgctttaagtggcacttaatgggccatactagtaggagcacggaagacagtgcagaagacaatgctgagggcaaattgaacattggaggcccaactcaagaagtttcagaggggaaccacattaggaagtggcctaaagactgttcttgggatattttggcaaagaatatgactgatttgtacacttttccctttcatgaggctaaatctacatgaggctaaattgaagagttttggattaatgccactggcagaggtttcaaagcagcctagtattgaccatgtcctgtggttattaataatcactcttatacctatctataataaaaaggagcaagctgtacaaagagctacaaattgtacagtttgaggagaaagggagcaccgcaagtggaatagagttcagttctgtgctcgaggagataaaggtttgaagaaaagcccgatcctaaatggaataaaggaagtggttatctcagtcttgcaccctcccaactgagcttccaacttgtgaaaagaattcaagaaaagcttgagcagtgacggaaaccattgacaacagaaagctgattcagatgtgatgtgatgtaattgaacaaggggagcaagttccagcgccatcaagaagcagaatttggcagcttcagtgatgaggttctggctttaaagtcaaggatacaagaaaggggttgtggattctccctccgtgactgaggaaagccactgagggacagacagcatgtgtcagaggggtccatgtatgcagccccagagaggccattatgtgaagctgtgagagtgaaatctggattgccttagagccagggaataactgccaaggaatgctacagagcaggcttggggccagcctaggagagagaagtcagcaaagctggaaatgaagtgagtaaaacagtttgctaatccctgaccccatcatgggctgaaatcaatggagatcagtctgaacctcaggtgtgcagagtacttacaggaaacaacttgctggccttgctttgcttttataacccaaaactgctcccctccctgatcaaacagtgatactgtggtgtcttatttggggttttattgctgtgaagaggcaccatgaccgaggcaactcttataaaggaaaccatgtatttggggttggcatagaggttcaaagatttagtccgttatcaacatggtgggatgcatggcaacgttcaggcagatatggtgctggggaaggagctaagagttctacatgatgatctgaaggcagcagaagcagactgtcacactgggcatagcttgctcatatatcacctcaaagcccacctccacagtgacatacttccttcaataaggccacacctcccaatatgactgccactccctatggccaagcattcaaacacatgactctatggaggacatacatattcaaaccaccccacacatggtaatacagcgccatatttgtaaaaatttcatatcctgctatgaaggccaacagccaccaatccctcattaatcctctaatcagcaccttaattgctggtatctacctactctgtactgggtaccagcttagtgcacagttaccctgccgcatcttccagcaaaaatcttccccaaggtatttacattctgccttctttcccccctcccccccacggaaagtgcccaacatgtggtttttgcctttgtatataaaaacttcagccgggcagtagtttaatcccagccctttgggaggcagaggcaggcgggtttctgagttcgaggccagcctggtctacaaagtgagttccaggacagtcagggctacatagagaaaccctgtccaaaaaaaaaaaaaaaaaaagaaagaaaaaagaaaaaagaaaaaaaaatcaaaaaaaaaaaaaaaaacaaaaacaaaacttcacagtcataaagaccttgtcttggtctcgttctcttgggtaagaacagctcaattaggacagaaggagctggagatctgaagagcactttgacatcagatgtggaggtgcagagtgaagtttgccctgtggttttcgtccttgctttggtccagtatttcctcactatgccccctttcttccttttcaaaatcattatatatattctgtgccattgtatggtagaaggatgtcgtctggttttttattttgattttataggaataacagttaagagattgctatgagtctcagaagatttttaaactttatatttttaaacagttttgagactattatagactatgaggatttttgaagttggattgtgtgcatttttgcattatgatattgctacaagcttatgaggcgccagggagtagaatgtactggttcaaataaaaatagaccttacagggctggagagatgtctcagcagttaagagcactgactgctctttcgaaggtcctgagttcaaatcctagcaaccacataatgtctcacaaccatccgtaatgagatctgataccctcttctggggtgtctgaagacagctacagtgtacctacatatgattaataaataaatctttttttaaaaaaatagaccttacaggttcatatatttgaatgtttagtcaccaaagaaatagtcctatttgggaaggatttggaggtgtggccttgttggaggagatgtggtcttgctggagaaagtgtgtcactggaggttagcttttaggtttcaaaagcccacaccaagcccagtctccctccatctgcttgtggatatggttgtagctctcagctacttctcaagcattctgcatgcctgctgtcatggtccttgccatgatgataatggactaagcccctaaaattgtaagcaagtctccaattaaatgcttgcttttatgagttgcttaggtcatggtgtctcttcacggcaatagaacagtgactaagacaaatatacatatattatcctttgacaatattagggattgaatccaggactctacacatgttatctatgtgttctactactaaggcacatcacaaatctttctcttttttatttatttaagacataaaagtcacattgcaaccaaggctgtcctagaatttaccataaatctcaggcttgctttgaattcacggaatcctcctgcctcagcctcatgcatattgctgagattacaagtgtgagtcaccaggccagttttgtgtgtgtgtgtgtgtgtgtgtgtgtgtgtttgtgcatacatgttaaggattgaagaaacaccaaacaaataagtacatagtacattagagaaaacattgcagagaaatataaaatgcttattcacccaagctgaatatgatgtttatcactaagaggcatcagtatggagaaggtgatttttcaggctgagccatacttactaaagcctaagcaaacccaacagtaggagaaatcttccccagaaattagtagaccttgaggatcagaaaagcaatgtgcggataacagtgcccaataaccttctgatgccctcctctatgagggaatggtaacagccagcaagaacaataagccctatggtcacggactcttaaaaactgatgtaatgaagatggtcattgttttgctcagaggggcacattctacaacagcagtttattcctaaatgtatcaacagaaaattaaaatgatctacaatgtaggtcatcaataaagcacttgctttgaacatatgaagaagactcttctgctacataaccctcacaatgagaactagcccctcatggtttcaagaaataagtcagtaagatcagttggagactacagcatggaaagtcagatagtcagaggaaaggtccttctgtcttcaagtgtgtcctctgaggttcctagagatggagagcagagcttaaaaaggagatgactgtctaccgtgggacagattagatcaccagccttcatcacaaaggcactaaattgaagtggacttgagtggaataggagaaagcatgtattaagggtaagctacagacaggtctgctttagaaggaagtgaaccatctttctgtcactgctgaggttatctgagtaaatatatagatgggttccaaaatgctctgatcctgtctttggagcacaggtcctgaccaatcctatgtggaatggctaagtgattcagaaagacctgagagagtggtagccttccctaggggttctcagaggaccagcagtaaccctcattaatcctctaatcagcaccttaattgctggtatcttcctactctgtactgggtgccagcctagtgcacagttaccctggcgcatctttcagcaaaaatcttccccaagatatttacattctgccttctttcctccccttcccccccccccccggagctcagaaaattgattttaattcaccaggctcctgttgcttagcagcagaagtgccttctcctagaaaccaggaaccaaagaggatactatcaaaagggggggctgtctgggccctgctcttgctcaaccaccaaatgctgcatccacaatacttcttctctcccatgctgagcattaagaggctgatcgctgggacagctgaatgaccttacctaacaccgacctgccagcctggggcctctttgagtcaaatgaataaggacagcaggaatacaacttgtgatgatgaggtagctgtaggtataaatcacataatctagatggatgttgtaggactctcattagcttactgaatggcagagggattctgttaccctgggtgactacaactccctcctggaacaggtacatacatgaccaccccagacactgaggttgaaggggactagggaccacataagataaatcactcctaaaagtatacaaactgaaattctggaatatcttaggcatacaggcctgatgaaatgccacaacacagaaccaaccaacatgatcagctttgctgttaggccagcgggcactgtcagaggctctgcccctccctgatgtgacagcaagaacaggatgttcaaccttgaagaagcaagcccctgcctccagctttctaagacagttccaggaccacgctgtagtggtcacctagggagaattacgacttgtctcgctttccaagaatctttgaaatagttaagaattcaggagatggccaaagcactgatattatatatttgctgtagagagaattataagagttttatttttctgatattaaaagttacttaataaaaaaaaagaaagaaagaaaaagaaaaaaaaagaattcaggagcaccaggagaggcctttccagaatttgactctgtgttgtgataatggatattttcccagaattcccacatcttgacagaaacagcagctgatggctccctgaggagtggaaagggaccctgtagtaactacagaaaagaaggcacaggaacttacatcaggagactcagccatctcttcccccaggttcaactcagaggctcatgcctgcctctgagcgagtttcttcctcctctccctccattcctcccaaggaacaggctttggcctctctcgtccactgcccagcacacaaacctgcctccacagactgaggggtagcatggctgccgccagaatgagggggctgaagagaagggccatgctagccgtctccaggcacaagctgctgcctgcacacccacagtgctgctagtgcacagggagtgacacacagagggttcctgtcacctctgtgggggttattcaccacaccaaatgccttcccaaggaggccaggtaaccacacttgggtacacaccttccttgacaactttctgtatcccacagtaaaactggctgtcacagaaaacagcaaacctaatcacaaaaatgtaagggttcctgtacacatcgcccagccttagagatggtcagctcccagacattcatctcagcactggatccctaggaatttcaggatgcaatccagaaggacaagaactcttgtcactcagccttgctgtcatgataagacctaggatgagtgctatcctaacacatcatccgatcctgagtgtcaaatgcctgatggctcattggtgtcgtgaaatgtactagtgtgcttttttcagtgtgcaacactagaagattctacatccttgcccaagcaacaccaagaaaaggttgcacaggtaggcttggtggcaaacacctttgatcccaccacttgggaggaagaggcaggtagacttctgtgagatcaaagccaacatgttctaaaaggggagtctctagaagagccatggctatacagaagagagaccctctaaaaagagaggcagagagatgggtgaagaaaaagagaaagaagtgccttcctcatgctctctgatagggttccagcacagggtagtcacccatggaaaaattccacagtgcacacactcttccataagtgtgttctccagagttgactgagtgacaggaaccgctggtcctcaggctcctccggagacctgcgggagctctgccttatgctacttaaggccatgcagggtcctcagttccaagatggcgctgagagtcagagcagtgaggtgaagaggtgacagaaccctagagttggattaacttatgtcagccttaaaggaagcccttggaaagaggacaaagagggcctccaccccaatcacccctaggcctctctgggtcttccctagcagatgtcataggccagcatagttccttttcctctcacctctctcctcccaggcgtttgtccttgagtagctccccggaatgtgatgactttgggaacctgattcctgagtgactgtgtcccctcttcagtgagctaccagagacattaggaaggtgtttcccacgtggtaaaccatctgcctgtttgcctgagtgaaggtcttccttgggcgagagatgaactgcaagtataagccagtttgtggggagacaagagaagccaagggtgtgggggaccttcaaagactgtcgggtctagggagaattggactgtttctgggttagggacaaagtcctctccggtgtcctctccttccctcccctccccctccctcttttccttccctcctccctccttcactgtcttcccttcccctcaggtctcctctcatcctttcctccccgctcttttgtggttctggatacactctagggccttctggatgctagactagtgttccatcactgaccacattcccagccccagaagcatatgaaagataaactcagttctctctctgtctctctctgtctctctctctctctgtttcactttgattatagtgatatgaaaggtggacttaggaatctttaaacatggcagaagttgggactatttagatagctcagacgttaaaagcacttgctgctcttcaagagggtctaggttctattcccaacacccacacaggatacaactagttgggtttttgtttactagaagagcacattttttttaacctcagccgcattatattccatatatattaaatgtaatttattttgacttattcactttacatctcgcttactgctccaggtcaccctctcccaccatccatcccccatacaactatttgtaattacaggttcagaggatctgaagccctcttctggcctctgtaggcactcatgtggtgcacagacaggcatgaaggcaaaacacgcatacacatttaaaaaataaaaatagattatttaattgattggtggatggattgatggatagaatgactagagatatggcagaagttcagtggttaggaaaaggcagttttttcattctgcggaagctcaggctcaaatgtttccttctcaagcctctgtctgtgattggacttttattggcctttacagttaacatgcatgtatccagaggctagaaagatgcagttataaagtactggctgcttttctagaggacctagattcaagtccccacacctgcatcggggcttacaactacttctaagtccagttcaagagggtctccctaagcacaaggaatacaccactccaaggaatacacacttagaggcacagacatccaaagagacaaaatacaaccaagtgtctggcatggggtgttttgctccttcaggctctcctgtatgtattacacaatgcttgtcctgtggattctgtattcactgagctctgtgacaccctgctcttagattctgaacttatcagtttaagtagattctctcttaggaattttccatccagcacccctacaccatgtcccccactagcacacacacacacacacacacacacacacacacaccttaactttttagatagatgtcagcttgatttgtcatgagcttagaactggggatggaagttgctaattatcaccatctattgctgccatggagaaacacttttcaggccttgaaatgacgtccgagcctctgcttggaccacaaacttcagaacttttaaaataatccccaaaagataaaaaagcaaacagaaaataacatctatcacaaatttacacctttaagcctttggagggggtggggcataagctattactatgcaacctagatcgtcatagaactcaaaattttcctgcctcaatctctgaaagtagtgagttacagacatacacaccagcccaatgaactgccaaaatgcaaatatatatgagtttatgtcatcataaaaattctgttcttaaactattagaaaatagagaaggccacatgatggcaggacaattaaaatactagaaaaacaaagcaaaacaaaaacagcaccatggtccttgccagtaatcctagcacttgggagaggaaggcaggaggttcagatattcaaggtcagctttggtaacaaaacacgttccagagcagcttatagtccatgaaattccatacagaaaggaaaggggagaaggagggagaggaggaggaaagaagaaaaagaggcggaggaggaaagacagcaagggagaagatggtcatcatgggaccctccacacatgcaggccaaacgtttatacaaataaaacaaatctaaaacgagttgggcagtggtggcgcgtgcctttaaatcccagcacttgggaggcagaggcaggcggatttctgagttcgaggccagcctggtctacgaagtgagttccaggatagtcagagctacacagagaaaccctgtctcaccaccccccaaaaaaaatctaaaaagaattaaaataaagaacaataaaatatacaatggcacacatctgcaatcccagcacccttatattgagttggaagacagagacaggaaaatcgcccagaaactcaggagcccagctagcctgtatgcagtgtactgtgtaagacagaagaaaagaggtcctgcttcagtaagatggaaggagagaactggctcctgaaaattgtcctctcacctccacatgggctgtcatggtgtgtggatgggcttgcacacacacacacacacacacacagagagagagagagagagagacagagagagacagagacagagagacagagacagagatgagagagagagagagagagagactagtagtattgtaattattaccaagctcactgttcctttgcagaaatctgtttaaattaaaataaagacaaaccagaaaaaaatttaatctttaggaaacttcaaaatttcagagcctcccattaattgggaccccatcaaaataaaactgaagctgagtatagctaactttgttttttgttctttgtttgtttttgagacaaggtttctctgtgtagcctgtctgttctgaatctctctgtctctctgtctctctctctgcctctctctctgtctctctgtctgtctctgtctgtctctctctctctctgtatgccaggctggcctcaaactcagattcatctgcctctgcctccttagtgctgggattaaaggggggccccaccaggcccagctgctacagaatgcaatatgattttggcagcaaaaccacaactggtttgatcttggctgcacttatgcagtggttttttacagtcatcctgacatttttgacataaactgtattgaagaaaaaaaaaaaaaaaaaaaaacagaacaaactatgcattgcctcttgtcaaagcatggtgaggaatactttattttagatttagatttaggaatttaggaattactaaaatctacattttagatgatggaaggttggggatcaactgtatatgaagcatggacaacttggaattcacaagaaaataaatgaaagtcaatgggcagaaagtcactaagtggaggaatcatcagggctcaggaggttctggttaaactgagctgagaggcagggagaaagcgccacagtgagcctccaaggaatgtgcttggacagcagttgtgttgggggtggggagccttgctaaactgacttagaagactgcacaaggaagtaaacaggtttaggagaaggttcaggagcttgactaaagattaaccaaacaaagaattttggcgccaactttggccccagttttagcaagaaccctgctgttagtttagggagactcttccacctttggtaactgatcacttaatagacctttgttcctacccttgatatctgaacactaactcaggcacagttgtcagcaagaattctatctggctgaggagttctggcacaaattttgaatcccagcacttgggaagcagaggcagatcaatttccgagttcgaggccagccgggtctaacagagtgagttccaggacagccagggctatagacagaaaccttttcttgaaaaaccacaaaaacaagaacaaaaacaaaaacaacaacaacaacaaaacgaaaaaagaaagaagaaaatcttatctggtcaggtaagcaagactctcccctacatttgctgggctctctagtaacatgttcaatccactcagtgtaaccaccaccctggccttcaggcccttcctgacacattgcttcttaactgtaaattcctgggtgtctttcctctattcgtcattgagcccagccccatactgagatctctcttttgttctactgcaaatttcttaacaatatttatctttatcatcactccaatgtccaactctagttttctttgacagaatccagacccttctttattattacagagaaccaagacccatagaatacctcttccaagaaaacaaggcacagcatggtgcagcaagatcatacccaaagcctcctgcatgctgtagtactaaactatgcccaaccccaaggcaattcttagtgaattttaaagataagcatgaacatttcaagaatgccagaagataatggcagacaattggagtgagtcagattgtatagggcctggtagccagagtttactttagactttggtttttattcaccataaaacgagcatccattatagatgctagcattccttctaggctctgccccatagtcaggtgtgcctgactcactaaaggggctgtttttcccctcctccctctctcttactcttttaccctctctgtcccttctctccccattcccttccccctctctctccacatattcctgcagcctctactctctctctctctccctctctctctctctctctctctctctctctccctccctccctccctccctccctctccctctccctccccctctccttcttcctctcccctcccccctctctctgcccttctctgcctgtacttcctccactccactccacatgccctaaataaactctattccatattatatcagtcctatgtctggtccctgggggggttggggggatgcctcagcactgacccacagaggcacccccttccacctcaacataccttgcttctgccaaacatatcctggttcttttttctcttttataaaacacaacaacagattttcaagaggtgagtaaaaatatttcatcaagtcataaactgaatcactttggcaatgatgctagtcaggagtgaactggctataggcaaaggctgaagttcttttttttttctctaaagatctattcattatatatgtgggtacactgtagctgtcttcagacaccccagaagaggccatcagatcccattacagatgattatgagccaccatgtggttgctgggaactgaactcaggacctctggaagagcagtcggtgcttttaacctctgagccatctctccagtccaaaggctgaagttctaaggccactcagaacatgtagccacatgacccttattgaggacctcttgctatgaatgatacatttgaaaagtgccatttctggtttattcagtcctcttaacttatcagcatctaggccagcactggaacttggtttacagttccaagactgtgttctttctattggcttacattacatttcattgctatttgccaataagaaggataaaaataaggtatgaagccaggcatggtggcacacacctttaattaaagcacttgagaggcagaggcaggcagatttctgagttcgaggccaccctggtctacaaagtgagttccaggacagccagggctatacagagaaatcctgtctcgaaaaaccaaaaaaaaaaaaaaaaaaaaaaagtgtggtaatgtacgcctttaatcccagaattctggagacaggcaagtgtagctgtgggttcgaggctagtttgatctacactatgagttctaggacagccagggtcaatgatgccatgtcacaaaaacaaaaaggaaaaaaaaagacaaaagtttttgccaggcctggtgttgcatgtctttaatcctagcacccaggaggtagagacaggcagatctctgaattcaaggccagcaagcagcctggtctataaagtgagttccaggacaaccagggactaaacagaaaaactcttctggggtggggcaaataaataatgaaacgggccaaagagatgactcagtggataaaggtacttgccaccaaacctgactgtctaaattcagttcacggaatccacaagtcagaaagagagacctaactcacaaaagttgttctatgatcttggacaccattgtaccagcacttgggaggcagaggcaggtggatttctgagttcaaggccagcctgctctacaaaatgagttccagggcagccagggctacacagagaaaccctgtctcaaaaaaaaaaaaaaaaaaaaaaaaaaaaggctcatattgcctagcatatatgagactgtttgatctctagaactgcataagcagaacatggtggcacacacctgtaatacaatcacttggtaggtgacagcaggagaatcagaagtttaaggttatcttggctacataataagttctgtaccagccaggaactaatgggaccctgtttcaagaaaaaaaaaagttctcaacctataggctgtgactcctttaggaaacctctacccccagaaatatttacattatgattcataacactagcaaaattacagttatgaagtagcaattaaaataattttataattggggtcatcacaacatgaggaactatattaaagggtagaagcattcagaaggttgagaaccactattttataaaaagaaatgaaacagttacttttaaaaaggcaacagggctgaagtgatggctcagcagataaaagcaccaactctcaaaagttgtcctctgatctccactacagcaacagaacgagcacgctagagcacacacacacacacacacacacacacacacacacacacactcacacactcacggacatgcacttatgagcacacacacaaataataatgacaaaatgctgtcttttgaaatcaggtatttggctcagaactgtaatcagaagactgatacgggcaaaacaatacaagttcgaggccaaccaaggctacttggcaaatctatgtctcaaaaacaaataaatgggctgataagatggctcagtggttaagagcactgactgctgttccagagatcctgagttcaaatcccagcaaccacatggtggttcacaaccatctgtaatggaatctgatgccctcttctggtgtgtctgaagacagctacagtgtacttacatataaccataaataaatctttaaaaaaaacaaaacaaataaaggctggaggttagtggtagagattttaccactatgtatcaagccctgggtttaacagtccctcgaaaaaacaataacaccaagaatagtgtcatggagagtttatctgggcagttaattgtaggttttgtttattctttattttttctgttatttcacaattaaataatagttttaaacttatggtttatttctagcaattaccatttaaatttaaatgttttcttagcacatgtcaattatacataatagtttcattacttcatagttgtacataacatatttcaattaaaatcatattcatccccactggttaccctctctcatccctcttctactccagctaacccccaccctcttcctgacctgtcccctactaccaccccactttctactttcatgtctttgtgtgcttgtatgggacaaacatataatttcttcacagtagtatggtacaaatgtttctgtaagcttgatgtgttcagcatccaagaaagagattgctaggccaaatttattggattggtttaggatacgtaaaggcaattacagcaaaggaagaaaaaaaaagtcttagcatagaactggcctccatctcacaggtaactaagttaggagggattctagccaaagggtacagtaaggctcagcagggagagaatgactaagacaaaaaatacctgggttaaaaggaaccatgattcaagtgactgtacttttgctgaaggcaggcctgggtgatgagataagcaggctagggaatcttgctgaactgacccagcaagatttttggctatgactgtactttagtcttgcctctcttaaggaggaaggatagagcctaaaagcaaagtttaatcgaaaagaaaaatcaaatagtcagaggcacactaagcagagaggctttgtcaactggttcttggatgcttgtttttcttaagtgaagggacaaaaagtggttaagaggccaaagctccagattttcttattctccccaagaaaataaagaaatgcagcgccaggttcagcacctactcccccaacctggagagcaaataccctagcaggtggttgcttggcacttttgggatgcggaaatggagaaagaagtggagaaaacatatgccaaaggtgtgaaaaaaataacttgctaatcaagaaatagaagctaagctactctacatgataaacagggacaaggagaagggagactataacccagtggggaatcggttgcccagcatctgggaagccctagcttccaaccccagtgtctgaaaacagtaaagtaagtagaaaatgtataaataagtagtatacttattaataatacataaaataaataagtacaaaggacatcagagagggagagaaagagagaaagaaaaaaaaagaaaagagaagagaagagaaaagaaaagaaaagaaaagaaaagaaaagaaaagaaaagaaaagaaaagaaaagaaaagaaaagagagaaggagagagagggggagagagggagcaatttccctgcagcttaaaggttctccagaggattggaattgtggacttatagcttacctttaccagagagactgaaaataagtacatttatgagaaatgttctacttcttcaatgttgacatctgactgacaaatatcattaagcaatttggagatgaaaatagacacacttgtgagcctggttttagattggcctgtttcttccttccttccttcctttcttccttccttccttccttccttccttccttcctttctttctttctttctttctttctttcattcagatttatttatttatttatttgatttttttcgagacagggtttctctgtgtagccctggctgtcctggaactcactttgtagaccaggctggcctcgaactcagaaatccgcctgcctctgcctcccaagtgctgggattaaaggcatgagccaccacggcccagcaagattgatttattattatatataagtacactgtagctgtcttcagacacaccagcagaagtcatcagatctcattacagatggttgtgagccaccatgtggttgctgggatttaaactcaggaccttcaggaaaagcagtcagtgctcaacctctgagccatctctccagccccagattggccattttctatctgctggtataggaatattgataaggccaaataaaattgcctttcccctgagacaaggatgagttgcctaaagcgaagaaatagaggacttaaaagtattggatgtgtccttaaaaaaggaccccgcttccttccttgctaccccataattctaggcccaatccctgaggaattaaactgttattggggagaataaatgcaaagatttcagtatcttggaaggacagggagaaagaaaataaccatatttaaagaattttgggatgtgtgactacaaagcttccagaattatgagacaagccataaaaaataatgttgagctggccacgatggcccacaccttcagttccagcactcaggaggcaaaggtcgatgggtctcagttctgagatctagattttatctatctaccccatgatgtatgactccccttacatgtgaaggatattcttgcttttattcttaccttttattgtatttttttataatagccaattatctcaccgttgtaaacatgttcaaagatcatttgtatgaaccttaacttttcctcataaaagggacctcaaaatgctagtaaggagttactctctcaaatccagacctaggctgagacagccagctggccaggcccaggacacctctaaaataaaagcttatgttaattggacagttgtggattggtctttctccccacaaattcaggtttaacaaagcgtctggacttctcacatagtaaacaaatcctctaccattgagctacatcatccctaggccttgatctgatccatttcttttcttttctttttttttgggggggggtcatttttttcttcatttacatttcaaatgctatcccctttcctaccctttcctagtttcctctccaaaagtcccctattaccaccaccaccaccacccccagccctgctccccaacccactcactcctgctccctggccctggtgttcccctgtactggggcatataatctttgtaagaccaagggcctctcctcccaataatggctgactaggccatcctctgctacatatgcagctagagacacaatctctgggggggtactggttagttcatattgttgttcctccagtagagttgcagacccctttagctccttgggtactttctctagctcctccattgggggccctgtgatccattcaatagctgactgtgagcatccacttctgtgtttgctaggccccgacatagtctcacaagagacagctatatcagagtcccttgtggggtttcttttgttgttgccttttaagatttaatggggaagaatgtgaactcagaaaagaaagaaaacgcaagcttaatacaataagcacattaaagatgccatggtcctgaactccagtggcctccaacaggaagcgaagagcccaggagtctcctgaaaccaagatactcaaatgccccactgttcctggattcaaaaggaagtctcaagctagatatagtggtgcacactttgagtcaaatcacttggaaagcagaggcaggaggatatctgttagttccaggccagcctggtccacatagtaagttccaggacagccaaagctatgcagagagaccctgtctcaagaaaggagaggagaggagaggagaggagaggagaggagaggagaggagaggagaggagaggagaggagaggagaggagaggagagggcagggcagggcagggcagggcagggcagggcagggcagggcagggcagggcagggcagggcagggcagggcaggacaggacaggacaggacaggacagagtaggacaggacaggacaggacaggacaggacagaaaatggaagcaaagtaaaagaaaaagaaggcttcattgacatcgttgtctgtcttcttggggggactgtgaaaggagtctccaagagccagtgggaggaccagatgttggtggccaccttagtgatctgaccagatttctctgacaaaaagacaaaaaaaaaaaaatccaaaacaacaacaataaaatcaatctactgatactggtttctactggcaaccaggtgtcttactttttgttttgtgtttgagccagggtctcaactctgtagcccaagctggcctcaattttgtggcaatcctccatcctcggtgctgggattaccagtacgagccacatcttatagatgtgtcataatttaaataattttctgctgactgacaaagaaacacttctcatttatcactagagtgagtaatgcaggcatgaacatgattctaattatgttttgagtatatatacatgaacatttacataggataaatttctaacacttaattactatttcaaaagataagcacttttttaaagaactttcatctatagtgccaaattgccttctggaaatgtcatgtgatattcacatttatcattgccccagacaacattaaatgtgtcattctttctcatctttgacagcttgatatttgaaagacagtatcttagggctatggatataacttaggggtagagcatctgcttagtatgttaaagccctaggtttaatccccagtaacaaaaactgtatatgtgtgttttcccaggcagtagatgacagattcccatgtttctgcttctttgggccatgtcctaagaggcctaacagccactgtggcccaacaatactgagaataactgctgggcaggaagatggttgttgtatacttagaggacatcaacatttctggaaacttctacagaaacaagttaaagtacctggcctttcaaggcaaatgaccaccaatccttccagtgacccttgtcactttcagaatttcagccatgtcatttagttcactatgccaggcatgctgccaaggtcaattgaagccaggctgccctggactccctaggggtgtttgatggaattcttttataccatgacaagaaaaagctgatcatggtgcctgccacacattgtaacaggcccccatatcttttttgtttttgtttgtttgtttttgttttgttttgttttttcgagacagggtttctttgtatagccttggctgtcctggaactcactctgtagaccaggctggcctcgaactcagaaatccgcctgtctctgcctcccaagtgctgggattaaaggcatatgctaccactgccaggccaggccccatatcttagcagatgcccacccacctcccactcccaccccaaccttagcacaatggactctagaaagtagcactcaggttgtaaaattcagcatgtagacagcaccacctacccaaaacaaacaaacaaaaaaccaaacagacagacaaaaaaagcaaagtcttaatccatcaaagtccatagttctgggcaagtctctaaattcactaaccttgcctttggacatcgatagtttggtttctggctaactgttcatattaactgaagtatatcaacccaggacattgttttgggattttaaaagctcactcggaataatgatggtgctacactgggatctttcaaacacacagtgtagtggctggttagctaataaagactttctattaccttaatctcatgtccaattagtcttctctgatggataccccaccatacctccaaggttgtgtgttgaagcctattagaaagttcgcttacctgcagtgcctggctcatgaggtcagctggaaaaaccaggtgctgagggctaccctggagaagaagaagatccactcctggaaacagcagctggcaaggctacagtaacaggcagaaaagaacgtggagaagaaaatcagacagttcacagatggctcaaacccaaccactgctcgtgtgagcccgatagatagactgagtttaaaagaagaaaaaaggaagataaaaagggaaattgggagctagtgagatggctcagctgttaagagcactgactcatcttccgaaggtcctgagttcaaatcccagcaaccacatggtggctcacaaccatctgtaatgagatctgacaccctcttctggggtgtctgaagacagtgacagtgtactcacttacataaaacaaaaataaatcttaaaaacaaacaaacagggggctagagagatggctcagcaggtaagaacactgactgctcttccaatggtcctgagttcaaatcccagcaaccacatggtagctcacaaccacctgtaatgagatctgatgccctcttctggtgcgtctgaagacaactacagtgtacttacatataataaataaataaatctttaaaaaaacaaacaaacaaacaaacaaaacccaagttgtcacatagccgagtctgctaaggatggcttgtggttggtttttccagtattacatgtgtcctcttatcctataatgaactgctacataagtggggacaatttgatggcaggaaacaggacctcaacttatccaagaagaagaataactaataaataagatctagcaatgtattcgatcaggtaagaccacaataaagaaccaggaagctgcaattaagaaatactctcagggccctactctgcctccctcagcttatcagcctcaaatccatcaaacaatggcaagaattccttgctttctaacagctaacagtttaagagctttgtggagactggttacaaacctaggttagataatgagttagtgactggaggctggagagatggatcagctggttaagagtactgactgttcttccagaggtcctgagttcaaatctcagcaaccacatggtggctcacaaccatctgtaatggaatccaatgctctcttctggtgtgtctgaagacagctacagtgtactcacatacataaaaataaataaaatacctttttttaaaaagttagtgagcagtttaacatgtccttttactcattttaagtagtcctagtgtgtaaggccaggcaagcagaatgctatttggaaaactaagacagcacctcaattttgcagtcagtatgtgcaatttagtgaaaattcatctcaaaataaagggggcctacgggtgcagccaggggtaaatcacttgtttagcatgtaggagccatctagggcataagcttcagcactcctctactgaatcaactgtattgtttctcagtttgtttgtttgtttgtttgtttgtttgttgcgctagaatcttactccacgaaccctgctttaatcccagcactccagaagaagagacaagcagatatctgtgagttcgaggccaacctggtctacagatcgagttctaggtcagccagggctacaacagagaaacctcatctcaaaaacaaaacaaaagaaaacaaaaaaacaacaccaacaaaagactagagagagagagagagagagagagagaggaaggaaggaaggaaggaaggaaggaaggaaggaaggaaggaaggaaggaagttagttagttgaacctaggacctgatgctcaacatgctctgccactgaactacactgtcggttctaattttataactctacttcattatttgttggcttgggttttttgttagttttttgtttttctgtttgagacagggtcttgctttacagtccagattgacctctaaccccaaagcccacgtgctggaattgcagatatgatctaagagtcccagctatatgtttttgatttaccaaacaaatgaaagatggaataggaagttttaccacttttactttttctgtcgttattaagtatttctactagtaaggtatatttgttagaactaatgaaccaattttcatgtattaaagctcaaatgttttgtttttgtttttgtttgtttgctttgctttgctttggtttgagacaaggtctcaatgtatagtccaggctgtcctggaactttctctgtagaccaggctggcctcaaactcaagagatcctcctgcctctgcctctcaagtgctgggaccaggcccttttctgctctagtaacttaggcagtatatggttacatttgtttgtttgttttgatggtttgcttttgaactctcaaccataaaattattttcattgctactttgtaactgtaattttactttatgagtcctaatgtaagtatttttggagatagaggtttgttgaaagagttgctccccacaggttgagtagcgctgttctaggctgtctgttagaactggtgctttttgggctgcagagatggctcaggggttgagaacactgattgctcttccagaggtcctgagttcaaatcccagaaaccacatggtgaattacaaccatctgtgatgagatctgatgatgccctcttctgctgtatctgaggacagctacaatgtactcatatataatagatgaatctaaaataaacaaacaaacaaacaaacaaaccgggcggtggtggtgcacgcctttaatcccagcacttgggaggcagaggcaggtggatttctgagttcgaggccagcctggtctacaaagtgagttccaggacagccagggctacacagagaaaccctgtctcgaaaaaacaaaacaaaaccaaacaaaaaacaacaacaacaaaaaaaaagatctggtgcttttcccacgattggactaggattttagattcatcacatctcatgaacacatgcaattggccttcagtattcctagtttctgcatccagagactcaaacaagttaaaaatactttactaaaacttgcatttgggggctggtgagatggctcagtgggtaagagcacccgactgctcttccaaaggtccggagttcaaatcccagcaaccacatggtggctcacaaccatccgtaacgagatctgacggcctcttctggtgtgtctgaagacagctacagagtacttacatataataaataaataaataaataaataaataaataaataaatctttaaaaaaaaacttgcatttggattgatcatagatagtttaaaattttgtaactgttcctaaataatatagtaaaacaatcatttacctagaattttcaatgtactagttattataagtaacgtataaatgatgtaaagatagagggaagctggtaatggtaggtaacatatgcctgttatctaagccaggagtttaagtccaggctcagctctgttttcagctccaggcaatcttgggctacatgagaccctcaataaaaagaaaacaaaaaaacaaaactaaacacacacacacagagagagagagagagagagagagagagagagagagagagagagagagagagagaaacttgggaggcagaagcaggaggtgctctgtgagttcgaggtcagcctggtctatagaatgagtttcagggcagccaaagctacacaaagagaccgtgtctccaaaaaccaaaataaaaaagtaaaaataaaacaaacacacacacacaaacaaacaaacaaaaacagaaaaacaaaacaaagtaaacgaacaaaccaaaaccaaaaacaaataaatacagaagcaggtaggccttcttcctcaacaccctgggaaatagattaaactacaaacttaggtgaggaaatagatgaaggaatgaagtgttagagaagtggactagcctgtgtaaggccctgctttaattatctacagtaccaaacataaaagtgaggttgagacaggaggattgcttttgaattggagaccaacctggactctataggagctccaggccagtgagagatatccagcaagaccctgtggcaaaagcaaaataaaataaacaaacaaacagtaagacaaaaccacaacattgattccattttaaaggggtgcaagataagttggacaagtatttttaattatctaatccctttcgactacatttctttgattgtaactccttataataagttgagtccaatggatccacctattcctaatgggtagctattggaaaccaatttgtgattatgagctacgaagttacattccactcaacataggtcttaacatgccatggatatgagccaaaaagagtctacctctgccacctagatttttcaggcaatcatgagaagaaattgacaaaacaatatgagaggaacagaatttgaaatagcctttcctggatgcagtaacagcggagtcttaggacagaggccgcttttggggtttctaacaggtcaggtctaaacacctgctccagagaaaacaaacaaaaataacggtgaaaaagtgagggaaggattttaattaaaatagccattttggcaagacagaaattaagcattgggccatttgtgatttgattacattgtggtctggttgatcattatattagtttggattctgccaggtggccacggagaagtctccatcaccctattattattttaggaacaatgtaatttccttgaaatgattgcttctgcttaggggtgatttaattatggagcgatctatgatcttcctggaatccaaggcagttgcaggtttaggacaacgagtggagattttcagggcttgccttttagagaacttcgaagagagcatggtaaaagctgatagtatatcgccctcacctttgtgccttcagccttgaagtggaatgagtaggttaggttagggatttaccagttttgaaacaggctttgaatgattaacatgtccatgtgcttcctaatgggtgtctgaaagaaaacaggtagatttttaaaatgataaagcagagaagtccacatgaggaatgtagtgttgttaaaagtgtctttatttatttgttctactagtatgaataaatgtttagaaaactcgtacatggtgagttctctctctctctctctctctctctctctctctctctccctctctctcttccctccctctctctcctctacagagtctgaatgagctgacagtccaaaaacagccctggattttagaattaatgaccagaaaacaaacgaggggaagggtttggttttcttaactggcatttcttgtcataatgatgaaaatatggccctttacaaggctttccaaaacccaggcctggcctctgcaagtaaagtagcacatttaggaggcaaaaaggaacggtttccatttcacactctaggtatagtctttagtcacttatatataaaagctgtcatgctcactcaaaatgctaggccaggccctgcagaggcacagggagactttcactcacatgtaattactactatttccactttagctataactattgcctgtcttaccaagtatagtgaagcagacagcaattataaacaacctaaggaacagagagctttggaccttgtgataggctaagtagcggtcttaggatctctctgtacagttgtctcttattccagcagcctttggaggccaggcttcctctgtggaccagaacccatctctactccaagacttgttgatcagttgctacccttccctgttcctggtttgggtcagggggctctgcccatgtgagtataggggtagggagagcccttctgtgaacaactatgacaggcaggttttctcccaaaagttctcagaaatggtcaaattaaaatgcaggtttgggtggggaaaagagataaggaccccccccccaaaaggagccatgagtatagttccagctcacctccgattctgtggcttcctctcagcttcaggaagacttggcccgggtccatggggagtccaatggggatccagcaacacctgggcccaagacaagcaagcgggagtcactaaagcccacttctaggtgtttacagactagagtaggaggtggaaatgcccaatgctgcctgtagcccacagtccttgcatttccctggatttgggtcctcaggaaccggaagtagggcctgcttgcccccacaccaccgctttcttccccaaaccaccagatctttctggtagccaggcacatatttcccgaagaatgaagtctagagtgggacaggagacccttgcctccccctgccacctccccacaaagacatacacacacacacacacacacacacacacagtagcagtagtcaaaacaaagggttccttataagagtgcctcatctatacttacagaattcatgtcagacccaacacctagccctatgcttggccagtgtacatagagggttgtgtgtgtgtgtgtgtgtgtgtgtgtgtgtgtgtgtgtgtgtgtgtgtgtgtgtgtgttgtgtctccaatggctgctttccggaacccccaaagcagcataaattgagtttaggatggacacagaaatttggaaagaggaagcaactaatcaacaatgaactagagatgggaccttgtccacagagcattgcctgggctctacagcagaagtctaaggggaaaagcttagggaggaatgcctgggcaaaggccctcattacttaagaaacaagtcctgacttcaaagtgagctccccagtccttagtatccctcacctgaagtcctgaggctctgtttccctactggggtccacacttgttaactgcctaagctcagatcagcagctgcatatcctgtttcttccctgaatttaggctcaaactaattcactgctttgttttgttgttacctttttgtttgagtttaagttggggagtgggggagtggggggtgggggtggggggtagtcttacttagcccagaataggatgacaaactgtcttgcctccacttctcaagtactagtgatcctgaagtgatgtgtcattgtcatcctggcagcttttgctctttttcattcttctttctataaccttcacctccccccccccatgccaccctcagttttggatggattctagaagtgctggtgggaaaaattattatttttcttagttgttttaattgtatttaaccttttccatctaaagttgtgtagcatgatgatttaaaatgtgaaaatagagggtctttaaaaccctgcatgaaaggatggatgatagggtgcttcctagcttgtatgagacccctgggttcatactcaataccaccaaaatggggtgtgtgtgtgtttcaatagcatgtcatgtcaatgaagatacatccagggcctgtgttttcatctattacaatgatggtaatacataacaatctccaggctaggcaggagctagacagacaaagttaatgtttaaaagaatactgagagcatatgaccagatggtttagtagggaaaggtgcttgccaccaagattatgatctgagtttgaaccccaggacccatatggtaggaggaccaactcacactagattcatctagtctccacaggagtgttatggggttctctctctctctctctctctctctctctctctctctctctctctctctctctctcccctctcttcctcatccctccccctcccaccctttcctccctatccctcttcctcccccctttctgtgtttctcaaaataaacgaattaatattcatcaatggctattgcatacataaacccaaggcagctgtggttgcctgtatgagatcaaaccaacctaaattccatcaggaaaggagaggctgcttcaagcttgtctgtagaggagtagctgttggaagttaattagttgattaattgtggagagagggagagtcgtttttctttggagttatggctgctggtaggttacccatgccctagtgaatgctaccacacccatgcatcctacgcaaagcatttactgaacacaagggattattaataagaaaaagaaaacataaatttgggagactggttggagggtcctgagggttagacatgatcaaaatacatgtgatttaaaataatgaaatagtactacacagttgtaataatgttttaaatgttgcctgggactcttggaatatcgcagttgagtcgtaggggcagggattactaacatgccctatgaatttgtctataagagtactgtggttcactcctgcagcttcaggcttctccagaggagcatgtgcttgtagcctcctaatcttctttccagagagagtgaaaataagtattttatgagacatgttctcctttttgatttgtttatttatgacagggcctcatgtagccctgactgactacagctcactgtgtagcccaggttggccttaaattcctaatcctacttcttttactgattttccattcagagaattgagattaaggtcttgcagcatgtctcccttccccccccagggcctcaggaatgttaaaacctagggtctaaacctagggccccaggagtgctaaggcagcactccccaccactctgcctcctcagctgtcccctttgtcaatgtgggcatctaattcagaaactctgtaaagcaatgtgcaggttaaataacatgcttgtgaacctgtgtttctgtcttctggcataggaatactgatgagacaaaataaggatgatcttcttctaagtagaaagaattacctaggagaagaaataaagaagtctaaccttgaatgagccttgataaagtgtaagatctttttttcctgttcaactctgactctcttgagcacaggagaaataaaattccagatgatttgaagggatgcaaatgcagaatccagggctgggtacatagctcagtgataatgcctagaatgatgtatagaccctagggttgaaaagaatgtggtttccagtgtaaaaatgagttgcatttcttgaggacttgggtttacaggacaaaaaaagaattataaaagctcactaatccttttgttataaactcagtcatagtcaaggtttgtcataaggtattcattgttaactgtccattggggagggttgttactattgctgttgtttgttttctagtgctgaggatggaatacaataccttgcacatgctaagcaagaactctaccatgaagctgcactccccagccccaaattacatgtttttatgtctatgaaagtgtgcttttcagaaaactcctgattgtaaatattattttgatctctgaagtatatttatttggaatcacggggttaattttattagagggagggaaagagcaacaacagcaaaacacctcagggcaggcaaactgtgaaagttcagcaggtacctggagaatggagagaaggagggtggagtggggagagtcaactgaaggcaggaggtgaagacactaaacatgacaggacactgtgaagaaaagcatgctttaaaaagggaagtgaaggaaaagttacacttacaagtgagtagatgaagaaatagaagtagaggaagaggtagagaatggggaagaggaagtacaggaagaggaggagaagaaggggaagaggaaggggaagaaaaggaaggggaagaggaaggggaataggaggaagaggtagagcaagaggtagtagaggaagaggaagaagtagagaaaggaggaagaggaagggcaagaggaggaagaggaggagcaggaggaagaggaacaagaggagaagaagaaggcagctggtgagatgtctcaggagttaagagcactgactacaccgggcttggtggtgcattcctttaagcctttaatcccagcactcgggagatagaggcaggtggatttctgagttcaaggccagcctgctttacagagccagttccaggatagccagggctaggaacagccagggctacacagagaaaccctgtctcaaaaaagaaaaaaaaaaaagaaaagaaaagaaaagaaaagaaaagggagaaggagaaggagaagaagaagaagaagaagaagaagaagaagaagaagaagaagaagaagaagaagaagaagaagaagaagaagaagaagaagaagagaaaaaaacaaaacaaacaaacaaaaagcactaactgctcttccagaggtcctgagttcaattcccagcaaccacaaggttgctcacaaccatctgaatcatctgcagtgggatacaatgccctcttctggtgtgtctgacagctacagtatgaagatgatctacagtgtactaatatacataaaataagtaaataaatcttttaaaaagcgagtaaacgcacacgcatttgatcccagcacttgggaggcagaggcaggcagatttctgagttcaaggccagcctggtctacaaagtgagttccaggacagccagggctatagagaaaccctgtctcaacccccccccccaaaaaaaagcgagtaaacatgtctctacatggctgcagtctgtaagatcctgccttctgaagaatttttcaacattttaaaagcttcaaactatacttaatgattatattttgttttgtatgtaaaactatataaatccaaactgtatcatcgatatctgtaagtccattatatgctgttacaggtttttgtttaggggctaaagatctcaataataaagcccacttgctcctcttgtagaaggtgtttctaaagacccatgttgggcacttctcaaccatctgcaaaaggcagctccagaactcagaaggcacctgcactcacatacaccacatacatatacataattcatattttaagaaatattttttaagaaggagagctggaaagatggctcagtgcttatgaataccggatgttcttcctgaagacccagatcgattccaacccctgcccccatacatggcaactcacaaccacctgtaactccagctctaggcgatctgatgtcctcttctggcttccatggctacttcatgcatgtgaaacacagacatacatccaagtgaaacaaccataaaatagaaaataaataaatcatttaagttatataaaataaaataattttgatgcttctacctttctcaaaatgattcatacacattatactactattttgtggtttataactgaatgtacactgtgtgaaaggtaagaggtttataatttctagttcctggtaggcatgatagcacatacctctaatcccagcatttaggacgccaaagcaggaggatcactgagttcaagatcagtctggtctatgtagcaagttccaggacagccagggctacacagaaagatcctgtctcaaaaaaaaaaaaaaaaaaaaaaaaaaagagggaaaaattgggttcttcttattagtattattttcgttcctattatgagtagtttgtatgcagtgtggcacgtgcctgtaagaagacagttttgtggagttggttctttactttctcctttaggtaggaaccagacaagtggtcaagctcacaccaccaggtagcaagcaagcgcttttacctgctgagcggggccagtttcctttcactggcctaagatggctttcaatattatttaaaagttaacaagatcagagctgagtgtggtgtttcatacctgtaatctcagtatttggggcactaagacagagagagatgtatgcttcagggggtcaattctgcgatagcatgagctctttttttttctcccgagacagggtttctctgtgtagccctggctgtcctggaactcactctgtagaccaggctggcctcgaactcagaaatctgcttgcctctgcctcccaagtgctgggattaaaggcgtgcaccaccatgcccggcttgagctcttgataaaataaaaaatcacttaaaataaaaccaaccaaccaaaaagctgacaaaatgaaataatctaaaagttatcaatataataaaactaaatataaaaagctatcaaagtcatcaatgttttcagaaacacttttatttgctctaaaagtctctgaagaaatgttacttcctcaaaatgttcttgcccccaccaccaaggaagtagtttctcttcttattttagtcagttgtctctcgcttcaaagcagtttatctctatctgacatacatatatagtatttgttagtaaattcaaagacgatgttccaagcttgctgtaatttttcactatcaatttctaatttagtgtgtcaaaacgaaccgtactcaaaggatccactagtgtccaattcaaaaatggctgtgccctatctgaacttcctcatggcaaccaaatagcatattgattataacatttttgacatgtttcccccccagtcttttcttgctttaagatgataattataatggtataggagtagcttccatctatcacgtttttgattagcaaagaaatgttagaaacagcgtacttagtaaaggatggcgtttaagggggttactaagcggtagcctcaatggggcattcccgagccagatgtccagactctccacagcggtagcagctgacttcgctcgtcttgctgcagttcaccgccatgtggccattctcaccacatctgtagcacttaatttgggtacaatctttctggatgtgcccaaattcaccacaagtgtagcatttctgttcttcttgccggttgcagtcccgagccagatgaccaggctgactgcagatgtaacagcactgctccctctctcgtttagcctgggtacagtccttagctatgtgtcctcttctcccgcagttgtagcaggtatcctggagaagatcacagtccttggcgtagtgaccagtttcaccacagcgataacaaacatcggactggttggcggtgctgcactggggacctctggtacgacctcttgctgttcgccctcgggttcctcccttaggacactcccgggcccagtggccagagtgtccacacttgaagcaacttttactgctcatgggtacggtgagatcttccggtgagcaggcccacaccccactgccacgggccccgaggctacctgcctaggatggcttagatggaaatggtcgcttttcctggcaggcctctgtgacgttaatgagctttgcacacggcctcaatggccacgtacatcacaaagcctttgggcttttttttttttttttttttttaagtttttttcaagagactggcctcgaactcagaaatccgcctgcctctgcctcttgagtgctgggattaaaggcgtgtgccaccatgccccacacttttctattttattttaatttagtttactttaggttggtttagttttagttttcccagacatcccgatatcatctcaccacctactccagcctcgtcttgaactcaagattcttttccctgggcatcatgagtgctagggctacatatatgtactgttacacacgcctaccttttttggggttggttttcaacacttgagttactaaatttggggatgaatctctttctgttcaggaattctgacctgtagaatatttcctaattcagttagtccctttagatgtggtggcacaggcctgtagtcccagactcaggaggcctacactacagtaacattgggtacgtaacaagaaaacttgattacttcctaaatcacaaagaaatccctttgcatatttgttatgttagcttaattcactaatttgaggcagggtcttgctgtgcagccctgtactacctgagactcacagtttaacacactctattgttagtttattgctgcaaacttaacttgcctgttttgtggaaatgagggcttttcaaatagcctagcttgccttcaagtaattgagaatgaacttctgatccttctgcctctacctccaatactactagtgtactaggactacacgaatgggctgccatgcctgacttgccatcttaactttcaacagaaaagcactatttaggttaggaaagaacaaaatgggggaagggaggaggggacaggggatttttggaggggaaactaggaaatgatgggataacatttgaaatgtaaataaagaaaatacctaattttaaaaagaaaagaattttaaataaataaatttaatttttttaaaaaaagagcaaaattgtagcattcaatataaaaccaatgttattgcttggaaaatatatgcaattaaaaggagttgggatatagctcacctatttgtttaggccatgggtttgatcccaaccaaaacaaaatataaatgcaatcagatattggatttcttgtctcataggtgtattccctactgtttataccttatatatgtacatgtacatttaaacaaatacaaaagtattagggctaagaaaatagcagtcttttaatttttctcttttctggtttgatttaaaaaaaaaaagatttacaccaaaagaatgtatcagaccccattacagatggttggaagccaccatgtagttactgggaattgaactcaggacctctggaagagcagtcagtactcttaacctctaagccatctcaccagcatgcttggttggtttttcagtcagggtttcatgaaggcgaaggtggcctttacctttattctctcactgctgcctcccagtgctgggctataggcatgcaataccacactcaactttaggtgaatgtgtatgtatgtgtctgtgacactggaggcctaactaggtcttacacatgttaggaaagcactccactagtgggctatatccccagcctgatagtctgtctcctttctttattttaatggtgttatactagagtatgcagctagggctaggtttaaatgattttactgccccagcctctccaaaggctagaattcatggcaatctaacctcttgaccttctttattgtatgtatgtatacatgtgtgtatgcatgcaagcatgtgtaataaataatatctgatggttcattttcaaaataactcctcaagacagtcagctttggtagaactagagaggaagaggaaacactgggcccctacattggagcctgcttaagttaactaccctcccccaatttctgctagtctaagcaccagcttcccaactaaaactttagagtgcaagtgcttgctgacaagagcctgatatggttgtctcttgagaggctctgccagagtctgacaagtacagaggagggtgcttgcagccaatcactggactaagcatagggtccccagtggaggagttagagaaaggactgaagaagctgaaggggttggaaccccataggaagaacagcaatatgaaccaaccagactccccacggctcccagggactaaatcaccaaccaaggagtccacgtggagggacccatgtctctagctccatatgtagcagaggatggccttgttgggcatcaatgggagaagaggcccttggtcctgtgaaggctggatgccccagtgtagcggaatgctagggcagggaggtgggagtgggtgaatgggtggaggagcaccctcatagaaagaaacaggaggaggagggatgggatagagtgtttcgggggggaatcatatttcctgggagaaaatcatatttcctggggaaatatctaataaaaaagaaaaaaagaaaaaagaaaagcataaaagttttgtttccaactttttaaggttttcagtatatactttttaaaatttatttctttattataggtaagtacactctagctgtcttcagacaccccagaagaggacatcagatctcattatggatggttgtgagccaccatgtggttgctgggatttgaactcaggaccttcggaagtacagtcagtgctcttacccactaaaccatctctccagccccagtatatacttttaagaaattatccttccttccttccttccttccttccttccttccttccttccttccttccttccttccttccttccttctttcctctctctctctccctctctctcgctctctctcgctctttctttctttctttctttctttctttctttctttctttctttctttctttctttctttctggtgaaggggatcaaatgcaagaccttgtgtatgataaacaaatgttttatcactgagctacatccctaaccccagcaaatttatttaaattataatttgtgtgtatatatgtgcatacaggtgtgtgtgtgtgtgtgtgtgtgtgtgtgtgtggttacgtgtattcatgtgtggatgtgtgtgcgtgtgtgtgtgtctgtgtctgtgtctatgtatgtgtctgtgtatgctgtgtgcagaggccagactttgactttagatgtcaaaacaacatcttttcacttcattctttttatttttttcaaacagtgccactcaatgaacctaaagctcgttgaatctacttgtcttaggctcagtcctctgccagccggggatcccaggcattctcctcggggcctccttggcttggctttctttctttctagcaaataggtttctttgggacttttttggtaaattaatggttccaagtgctataatcaattcctttgaataggagacaataaccaagtcaaaagaacaaacgcttgttaattatcagaaaagtttacggccatctggtgtgctgatagagcacagagaataatttttataactaactcaacaaactccttccactcttctcaggctaagtcattaggcaggtccaatcttacatgtcatgtaggtcttacatgtcatgcagctctctactgctgacatttgtcttctctcaacaacaacaacaaaaaacatgaataggttcatctctgttttatatcctgactattttcaagtttatcaggcaagcctagctgttagtaatttgtactctaaagttgtcgttttttaatgcttagtctttttgtttatttgggtttttttttgtagtattttttttttttttttgtattttttgtttttttgcttttccagacagggtttctctgtgttagctctggctgtcctggaactcactttgtagaccaggctggccttgaactcagaaatccgcctgtctctgcctcccaagtgctgggattaaaggggtgcgccaccaccgcccagtgagacagagtcttattgtgtagccctggctatcctggaactcactctgtagaccaggctggcctaaactcacagagatcatgtgcctctgcctcctgagtgctgggattgaaggcactgcacattgcttcctttttttttttttttttttttttgaaataggatttcattctatagctcaggctggcatgaaatttactatgcagcctaagttgacttcaaatcattgatcctgccaggcagtgatggcgcatgcctttaatcccagcacttggtaggtagaggcaggcagatttctgagttcgaggccagcctggtctactgagtgagtctgagtcccaggacagccagggctatacagtgaaaccctgtctcagaaaaaaaatatcattgatccttcggcctcatttcccaagtgctgggattacaggatcacaaacacaaaaccactgaacttaggtgctatatcccctgccccaaagctgttttttgtgtctgtctgtctttctttctttctttctttctttctttctttctttctttctttctttctttcttccttccttccttccttccttccttccttccttccttcctttcttcctttctttctttctttctttctttctttctttctttctttctttctttctttctttctttctttctttcttcctgtctatgtctgtctttttctttctttcttagatttatttatctattatatataagtacactgtaactgtcttcagacacactagtagagggtgtcagatctcattacagatggggttgtgagccaccatgtggttgctggaaattgaactcaggacctctggaagagcaatcagtactcttaagtgctgagccatctctccagtctctctctctctctctgtctctctctgtctctgtttctctgtctttctatggtcagggtgttatatatcccaggtttgccttgaactttctatgtagctgaagatgaccttgtatttgatcattctctctatttcttgaatgctgacattacaggtgtgtttaagtagtactgggcatctgaagccagagctatgtccaggaaaatactctcccaactgagccacatcctcaaaccctaaactacaattgttcctatctcttataattaaaaatatcagagaaattaaattctaggaaagagatatcttggaaatttagagatgatttctaacatttctatttatgtttacagtttgtcagatgaacaaatatgttgtttcccctggtggcaatcaagaaaaactctcttacatggaatcttcagatggaactaagcttgttttacaagaaaaattgtttgaactttattttgttttttgtttttaaagatctatttacttttacttatataagtacactgaactgtcttcagacacacaccagaagaatgcatcagagtcctttacagatggttgtgagtcaccaagtggttgctgggaattgaactcaggacctctggaagagcagtcagtgcttttgacgtctgagccatctctccagacctagtttggagcttgtaagtacagcctgttaattctgcatgagtacaactttgttcgagatgtgagctaacacttttgtagtgaactccaggtaaacttagcttaaaggcttctttcattgctcaaattgggctgaaaagagcttttccatcacactcccttccccctcaaagaaaaagctctttcagaaaccagggagggaattgtcaaagtggggatgtcttactaaagctgaaacatcagaggggttttttatgcatgttacctatatgtccattaggtgtcgcaatatatccaatggccctgccttctacttctattctgctcatgatattgtttcagatgcaggcatgggactgcttttccttttctcctcctcctcctcctcctcgacctccttcccttcttcctcctccttttttcttctttgtcttcctcctcccctcccccactcttttttacttgtatggttctggtgctttgatgctctacatgaaaattcacaattcaatgcaatgatagatagacaggcaggagccagtcggatgatctctcaagatccagggctgaataagaagggggagtggatcttaaggagacccttaaaactcaagattctccacaggaaacaacatgctgagagtgaaaatagcctgccccaagagttctggttccaggtattagaaaaagactttttcttcaggctttgtaacttgggcccacaattaaatctacatacgtatatttccattcccccaaccccccggatcggtggaggctatttttttttccttcaggatcttttgtggtccaagctgacctagaatttgtcatggaggtgaggttgtctataaatcgctggaattacaggcacttatcaccatgccagtggttggttggttggtttgttagtttgtttgttttcgaaacacttggaatattgggtacatcaggaaatatgagggggcctagcagagctccagagaagcagagaaggtcaagaattgtagggtgagccagaaagggaataataacagtagtgagatgtgatggtaaattaaaaaggatggggacttattgattagaaaaggggctgaggaaaggatgggtggtggacgccggtatgagcagaggtaggaaaagaagtgtgggctagggacctgagtactggactcagtgggctgctgtaagttgtagaggggcgctctgaggagagggaggagcgcggcgcatgcgttgcagcacagcgcagcgctcctggagaggctgtgggttcgtggcatccgcgccgcggccgcaagtatagcaggtttcgtacctggtgttcatcgccgttaagtcatcgctgctgccacccaggcacggctctctatgccgccgctccctccaccctctaggcactgcctgccgtaagaattttaactgcgacactcgcttcagcaggaggtaaaggaacgacgaaggacgaaaatgtaacatggagggcggaggagggaacttgtgtcagggagatccttaatttgtgcattttctcctttgaggggagggagaactggaggccagtacgaatccccagccctccaaaaggatgttgcgcattacttaatattatgaaagatttttagacttctctaagcaggtttaaggcacctgagcatcactgttttgtttgacatctatttaaaacaaaacaaaaaaaactttcgagttcttcatttgttaagggtgaatcaaatggatgagtctttaggattaggcttcatccgctttttgttttccttgggggtgagtgaatgtagtttgagactgacagcagcaggcctcgaactcgcggccgttctcctgcttaaactgggattacaggcgtaaatcaccacgccggactctgattcagtggttttaggttggagggtttttaactgtattaaggaatccgtctaccaagtagcctctcccttaggctgctgacggattccatctgggtttgggatatgctttatcgcctacgacgtttttttaattccatgtgtaacttagtttatcacagttaatcctgttaaggattgttgttaatgatatggtttagacactggggcataactttggcgagaaacacgtgcagatgcacccggcatgaatatatatacatatatatgcgcatatatgtatatatattcttcacagagttatctcaccagagtagcagaacgcagtggccacagagattatatatataatatatataatatatatatatacacatatacgtatatatattatatatataatcatacacgagaagggagaatagtaaagataggcgcgctttgcgtggatgccaaaagaggaaccatatcaccaggtggtggcgctcaagtacccttgagaaagcgtgacatgatgggtaggactctgctggcacgggagatcgtggccccttaggcgagggtggggcagagaggagagaaggtgaaatcacgcatgctcactgcaagcagaaggcctctgcgcgggaatgaaagtgcgcatgcgtaagagggagcatgttggccgtttaacactaggtatcgagaactgcgcgtgcgtgttgccagtggcttggctgggagggagggagggagacgcggaacgttctggtaattatgattgcgaaatagcgaggggttcggtaagttgtccttcgctcaaatcgccattttagtctgggagtacacttagagaggcagttctaccattctagttgttgaagagattagtctgagtggagggtgtgaccaaacccactggaaaagaaaaaatcattccagaatcttagtctctccctggtcagtctgataatgggattttaaaatacagaggcaatagtgaggctgcgaaagattgcttccgcagcatgttgcgcttctagtccaaccacattcagacaaagcctatgcaaaagatcctggccgagcttggctctccgcagactcatatcaccagagtagcagaacgttgtgaccacagcgaagtgcgttaaaaacccttgggtttttctcccctacagaacatagggcagaggatttcactgtgtttctaagtgcttctacattggttgaaacctaagatctgagcaaaccacctcctgaaactctgatatgcagagtcatgtcattgtcattaccctgaaaagtaaaggcagtggtgataggaaagtgtcccggggcttacgtcttcccctccaccccaaacacacacacctttctcttctgtggaactttctgcatcatttggtctgaggtagaagtgggagattggaggttggttgtttgcttttctttggctgcagaactgttgtgcctttgaggattgctagtgaaaatctatagtagttaattgcttaaaactagtaatttagcatttagatataggaaagggtacagaagtttaaaatgtcttttctattctgccaatcttttgctgttacagtttcattctctgggcccgtttatcaactaattcatatacaggtctatagtacttactatcacaagagaccagcataaaggttttacataatgcgctaacattaacttatttcgtagcccccacaatcctatggactagataaactattactcattttattaaaaatgagaactttgagaacacattaatttgtctaaggttttatagcccattggatgggcaaggtatttctccaggttttattgctgcataattctgtgttcttagacatgccttatcccttatattgaagggacacagttaagagttctttcaatttttgtctgaaaccataaaccttaaggaaagcattaagaaaagagacagttgtctgttttttaccccagtgcatagtatttggttacccaaatggaagagaacagtgcattgttgctgtggaacccgtgggggtggctctccttaatgttcagttgtcttctgtattttttgttctgcagagggtataaaatggccgactgcaagatgctggacacactctttttttttaatattttttattacatattttcctcaattacatttccaatgctatcccaaaagtcccccataccctcccccccacttccctacccacccatccccatttttttggccctggcgttcccctgtactggggcatataaagtttgcgtgtccaatgggcctctctttccagtgatggccgactaggccatcttttgatacatatgcagctagagtcaagagctccggggtactggttagttcataatgttgttgcacctatagggttgcagatccctttagctccttggctactttctctagctcctccatggacacactcttgtttttgcttgattagtaggtccaaggcaatcacacttgcttcagacagattcgttttggaaaaccttttattgataacgtcttatgttaactcataaagattgacttttgttggtaatataagaaaaatattagttaaaattatttagttagattcatttacatggaattgttatatcaaatggtatgaacattttatcgcttgatcaaataattgtcaaattcttccccaaaagattgtaccagtgtttactcagaaggtctgcctgaggctttagataaattgtataaaaaagaaacagcacggtttttccttttttggggggtgggggaggtgttgaggaagggtttctctgtatatccctggctgtcctggaactctgttgaccaggctggactcgaactcataaatttgcctgcctctgcctaccaagtgctgggattaaaggcgtgtgccactactgcccggcttttccttgtttttaattggtgaaattaaaatttttctttgtatgtttttcaattttatttttattcatctaatatttcatatcttaatatctgttgaaatgttaacttttactgcttattgccccttaatattctactgcgcagatttctataacatggataaataacgatgttattattatttgacatcccatctttttaaatcttggggaaatatagatttgataccatgtggtcagatttttttttcttccattcttcacatttgaataggtctccaaacacactaaatactcactgtggctttgtctgtggataaccattcagaggaaaaagctaatatcacccagagacagtgttaactagattgttcactagttttctctctttttgtgttcttctgtatagttgatatagttcatgttatattttctgtttaacattatgtgtatatttccacatttgtcattcaatggtttcatatgtgttaagtattttatgcagttttttagtaaattatttaatcaaaatctttttgtttttattcgatttttgtttcttttttaaaagatttatttattattatacataagtacactgtagttgtcttcagacgtaccagaagaaggcatcagatctcattataaatggttgtgagccaccatgtggttgctgggatttgaactcaagaccttcggaagagcagtcggtgctcttacccactgagccatctcaccagccctctgtttcttttttttttttttttccattttttattaggtatttaactcatttacatttccaatgctataccaaaagtcccccatatccacccacccccactcccctgcccacccactccccctttttggccctggtattcccctgtactggggcatacctctgtttctttttaaaaaaaaaaaacttattattattccagggataggggcatatgtgccatgttgtgtggcggtcagatgtcaactttgaggttggtgtcttatgtcattatgtgggtttcaggaactgaactcgggttggtcactaggcatgtgtggcaggcttcttggcctactgtttgccctgatttgttgttgttgttgttgttgttgtttttctctttcttcatcaaggtccagaaatagaactactcattaaagattgcaatgaatattggtcgtaattgctttccagaaaattatgtcattctttgcacctagtcatttaagtacttaatttttttctcacttaatatgcaaaagaatgatatgtaaaaattattttgaaaaacaatgtatgtattttgtttggagaccgggtcttacatatactgggctggcatcaggatgatataaactgctgatctccacgccttcctccttcattacaaatgtataccactagttcctgttcttgttttaaaatgaaataatgagctcataggtaatgtaggtccccaaacccgggtttcagtgtatatactgccagtatatattattgtatatattattgtcatttgttggaaccagcctagagcttttagctcagtagctaaagcctgaccacttgagttcaaacccagatccacagggttggattagagccaactcctgaaattctcatctccatgtgcacctgcctatatgcacataaataaattcaacaatgataataaaaaccctaggccgtcttacttcaaatgtgaagggtgggaagacagctagctcaattggtagagcacttacttgcctagtctgaacaaagctatcggtttgatccccagcacagcataaaatcagctatggtacgcatgtttgcaatcccatcactcgggaagaaaacataaggaccgtgcttagctacctaattcaagtctaacctgaagtgcatgaaaaccccttccttaaaagaaaaagtgttaaaaccaagcatggtggcgcatgcctatataatcctagcactctctagagaacgaggccagaggattgctgtgagttggctacacagcaaaatcttgtctcataaaaacaatttaaaaaacccaccttccaaaacaaaacaaaacaaaacaaaaaaccctatggaacaaccatggaacgttttttgtttgtttctgaataacaaatttactacaaaagatttgctgtttcaggcaagttgtccagaatcattaccagatttttgtttttgaagggaggactctacacttgacagtaaggcctgtggtgtttaatgttccagtttgagttcagtcacacttgcttatatcttcaatattcactacttagagctgccgggagagagagaatgttgtaaagaactggtgaaatgcttttaaaacatacaactagagcaccggaaagtgaagaaaggaggtcaagcaattaagaagtaccccccctcaaaacaacaaaaaaaatcccaaagcggaaaaacccatcattcctgagaactgcctttattgacaatgttttaccattaaaccacgatagggaaagttagtaaaaatcaataaaagcagagagccattgctttaaaagtcgtgcaaaaatctagatgatacatcttttactgatggatgctcagggttaggagcattttttaaaaagtcgtgcagaactatgggtgtgcaatactaggcactgctgatctttcaaaatgcttaaacattatcctcaacttgtctacattaaaatatacaaatttagtcaggaaatacatgtcagatgctgccactagttattctggatcttttcaagtttaaaggcccttcccggaagatggaattcggagggtcagtactgaccacgtgaaagtaacgctttgttctctggcatccctcccccgcccccccccccccgcgcgcgctccttttgaggttctgggggtggggctgctgaagtctctaggactgacttccatcttcctgtggacgcaaggacaaagcttgatcttaaaggtcttcacatcataaatgctgtgctcatctgattctggtttaaaccggaaatttgctcttttagcaaactctggccctaaagatcccttgtggggtgctcaaccattttgttggctccagccggctcgcctcacacgcgcgtgtaagggctaggatccatttccgggtgacatcgcgtctacggcctctcgggaaatgtagtgtcaggtagtacgcgggctgagccagcacgtcgcccgtcgcccgccgccccccccccccccccgccctccgcccgccgcgtccgccgcctgaaggaagcttcttttcccgcgcctcgcgcgctagcgcgggtggcagagaaggaagtgacgcaccggggtaaggccgggactcggagcggggtggggggggagttgggggggtctcccggagctggggtgctccttgcagcacatgctgctgaagctgtgccagatgttgggactcacaaataaatttttacagtggtaatctctccttaaagagactattactgttgcccagttttgaaacgggagtgaaaatgtgttgcttgcttgctttattctggtttttaaaatacaaactaatcagatgttctcagactttgtgggaagggtggccagtattctttaattactgaaactagttgctcctgatccatatacgctttgtttagttaggcttactagatacagtggtctaacttatttttattccatatgttgtatgtttcatctattgcatttcttagtctttctccctgtgcgtgcgaattacgtctgtccgtccgtgtgtgtgtgtctttattttagcatgaccattgaatgtctggtcctactttacgtccgtgtgtgtgtgtgtgtgtgtgcgcgcgcgtgcgcgcgcatgtgtgtatgtgttatatgcgcgttatcttacgtattttagcatgaccattgaatgtctggttgtctggtcctactgcctccacttctctggtgctggtggcattgctacgtttgtttttgtttttatttttacatatttctgaaacagtctcacttaacgtggctcaggctggtctgatgctccctatttaatgctggcttgccagttgtagggatcgttctgcctcagagtcccacgtactaggattatagacctagcaaatggaactttttaaaaatcagagtaggctgtagatctgggggtatgaagttgccgagggagtttaactgctttcaactacatcgttacgctgactttaacctagttggttgcaacctcttatttttcagtatttttctagctgtagatagtattaaattggacttgtatgtagtgggttggatatactgagatattagggtggggtcatgctttacagaaaattgatggaaaacattctttttggagctctgtgcttgtcttaagcattctaccccatgccagcagctgcttcttcaatataagtaggatccggaattaggggaaatttggaatagtttgaaatgtctcctcctccattaaagcatttaaccctttatatccctccccacccccatctccagttgttacagcccgggaagaaattttacatcagccagtataatacaacctgtatttagtcagactgtattctgtctgggtacatagctggtttgctatgagggcaggggaagtttccttttcaaagctcattctggcatattagtaggcctccgtaaatctttatcggatgaataataattagtccatcagcaagcatctgtgtgcttggtaaagtcacctctacaggttctttttctgttttgttttggttggttggttttggtttttggtttttttcgcctctacaggagggtcttgaccatgttattgaaaatggtcagacactttctatttctctctagttaattattttatcggggattttcaagagacagttctggttttgtgtctgcatctctggccttggtatttgcacatttccattgttggaacggctgacatttactttcttttttaaaactcttttttcacagattttattggctgcagacacacgcagcatcttcttgcgctcctccttgaggtggatgggcagctagctggagatgacacaggatgatgcgcatctttcgcacgctggctccaagatctccgctgccaggtacaagggcgcccccgtgcccttgcgctcttcatagtgggcccatgcatatcaatcagtgaacgcagtcaatggggaaacttccttcttgcgagggaactgcaggcccgcgcaccatgagcacaactaggccttggcgtgcacctgcccaccctgcttgcctcgcccggacatgctccactgcgcctgaagctcccacgggctcgtgccgcacgccagacatttattttcatgatggagcctggatgctagattttaactcagcctcacggcccagtgtttgccaaatggctctttttttcttgttttcatttctcattcaacctatgccaccgccaccgttactggagccaccctttaaatatataaagccatgtagccccggggacccctatttttgttactacttttgtgtcatacagtcatactcgttccttaacatttttggctccgactgctttggcaaagcttttgcattcacccacttcgttcaccagggatcctttgaccatttagaaacgcattaagcagcatatggtaatcgcagcacgggaaagttgaggctggaggatcagcatgggtttgaagctagcctgggatacaggagtaaatcctccatccacaccttccgccccccccacccccccatccaaaaggagaaagaaagaaactccttattacttttgcaagggttttgtttgtatgtttgttttttgttattgctgttgttgatttttttcagacagggtttctctgtgtagccttggctgttctggaactctctcttcagatcagaccttcgggctactgatgcaatgtagtacttcctgaacattaactgaacagtttaccaactcctctgctatcattccccgctcccttttaaaaaaagaatttccacttctgagctagtgtctgctgtaggccagtctgcctttgaaccaaactcccgattctcctgtctcagccttcagagtgctgggattgcaggcatgggcactgtacctggcaattaattactactaattttgttttttaacctttatttttatgtgtattggtgttttgcctataggggtgtgtgtaccatgttcgtgaggtgcccgatgacaccaggaagtgtactggaatcccctggaactggagttagagtaggttgtgagccaccatgtgggtgctggtaagagcagccactgctcctaactgccaaagccatctctccagctcctaactttgatttttatttatttatttttttactttgttatgttttgttttgtgataaactttctcagtgtagctcgggctgttctggaacttgctctgtagaccaggctggtcccactacctgtctgcctctaactttttttaatgcactcatttcattttaaatcaagtcaacatgtattagcagttgcatgttttagaaatggttgtggagaatggggtcagggttgtaatgaaaacaaaacaaaacaaaaaaaccaaaacctagttgtttttgttttctttctttttttttttttttttttttttttttgagacagagtctctctgtgtagccctggctgtccttttttttttttttttaagatttttttttatttattattatacataagtatactgtatgtcttcagacacaccagaagagggtgtcagattttgttatgggtggttgtgagccaccatgtggttgctgggatttgaactcaggactttcggaagagcactcggtgttcttacccgctgagctatcttgccagccccagccctggctgtcctgaaactcactctgtagaccaggctggcctcaaacttttgtttttcgattatctgtaagagaataatgtttctgttcccttcagatgcagcaacaaagcttctttgtacagacagccctggacacacttccagcagcaattcttcttgcaggaactggtgcaagaacaggatttattcgtggcacaggagcagttggtgtccactgggagtggaggcagaagagagaccagagcgggtatgttaggagagaaagcaggtgtgtaaagttactcactcagatttattctgctagccagctggaatagtactaagtaagtttagagcccacccctggcccaagagcaaaagcactgttttggtagtgagcctaagagtttgttgtgaccccagcacttgggaggcagaggcaggcagatttctgagtttgaggccagcctggtctacaaagtaagttccaggacagctagggctacacagagaaaccctgccttgaaaaaacaaaaacaaacacaaacaaacaaaaaagaccagagttactctaatgctgaaagcagataagatcacaacaaaatgaaatgaagcagcagtggcccttattgctcaagtctgacaacctcaattcagtcctcagacccctggaaggagagacctgactcctcaaagatggcctctgaccactacatgcatattctctccctccctccctccctccctccctccctccctccctccctccctccctctctccttccctctctccttccctctccctctctcctatctgtctgcctgcctgtctgtctgtctgtctgtctctctctctctctgtcacaaatacatacacataccctgtcttgaaaaaccaaaaccaaccccccccccaaaaaaagaatttgttgtgattcattttactacactgaaaagtaaaatgaaagaaagtgaaatgaaataaaaccaactctgcctcagggtacagtccaaggtctgctctcaccaaagcaagcattaaaaacaacaaaaccccaccctaatggggcttagagcgaagatctgggccagggttataaaggcttgctcagtcttgttccctgaaccgaaagaaacccaaaatggaggttactttagtgatgagctctttctggaggtgaaaaggtgggacggaccttacagatttatttttcaaactattttcaagtacccatgtagaattcctcattcctagatttgtaggggacattttactgtatttgctttatcttattcattcctgattgttgggcttttttttttaaagttcattttcatttcatttgtatctgatttatcagggtgcagaaaaacagcttcttttttatttttttctcatatattttccatgatgagatgaatattaattagcacagcctacctaaatacaaccatttagcttttgaaagcatggcttctgctcattgtttgctgaaaatcataagaggaagggaagctgtaaagccaggcttagtactctaggcaggccccatcccagtctgcctcaagtactttgtgctggctaagtgtctacaacaaaaggaaaagttgaaataccaaagaaggtagaattagcattagcataactttgaattccagtgatcaggactttacattcacaatgcttgtagttttcctttagtcaattggataaattagaaaagaggacaaaatcccactgtggcatctttactcccatgtagggagtcgctgtggggtgtaagcagaatggcttgcggttacacagagaagcccaggttgaaaaacaacaaacagccaggcaatcccagcacttgggaggcagaggcaggcggatttctgagcttgaggccagcccagtctacagagtgagttctaggacagccagggctacacagagaaaccctatctcaaaaaaaaaaaaaacaaaacaaaacaaaaataaaaacaaaaaacaaaaaaacacaaaaacaaagcccaagcaagatggctgtttatttttatcttgaactctggttgcctctgtgtttgttaccttaatttaagtgaaaaggcagaatccacatcatagtcccttttttttatttcccttagaaataaagatttatattcattgcagggtatatatgccaaagtatgtatttagggatatataaaaagttttaaggatgggcgtgttcacagatttgatagccgtaagtaatggaaaaatctgttcacgcgtaggaaattattaaataaaacttggtgtattcatgtacaatgacaaagctgctgaaaataaaaatattctcaatacccaggaggcagaggcaggtagatctgtagaagttcaagatcagtgtggtctatgtagcaagatccagactagccaaagactacattattgagatcctgtctcaaaaataaatgaatgaatgtagaagaaatctaaaagtaataaagctaatcttataagggatttgctgttagatttgcttaggagacatctaatcacaaaaagtagaattagcgaatggaggtccgcttttaaagctccacaaagatgcgtagttagaaggccggttaggatgctagatgtaaatgattgtttatccaccaggatagaccccctttaggcacattcacataaccaaaggagacaatcagggcttaaaaacagccattaagaccattcccagggaatattcctctagcaactccaagggggcagtacaggatcacaaccaaagttaacttctggcttgctataaagttcttgggatttctttttgtgggagcaggagcataattatgccagatagaaagatcaccctgggtaacaactatttgaaaagaacaatattgctgtgcttaaataattcgggctagcctgggcgtggtggcgcacacctttactcccacactgaggaggcagaggcaggcggatctttttagtttgaagccagcctgaacaaaaccaaaagaaggaaaacaaacaaacaaacaaaaaccagaaataattctggcactatcattgctttataaatttcccatttcagtggccagactaaatctccaggctctggttattgttaaaagtaatgagggctctgggacatcaaaaaggtttaaggcagatatacctttttcttttcaaggcctctcttctttgagcaagtggtattaaagagcttttcctttattaatctcaaagtatctgaagtgatctcttactgagtgagaaaagggtgttatttctataacaaaatcaattaaaagggcaatcaaagcatggtggcccgtgcctgtcatcctagcacctgggaaggggtggcaggataatctggagtggagtcgtcttcgctccgtagagtttaaggctaatctgggttacttaagaccatctcaaaacaaagaaaatgtctccgatgaatattgacttcgactacattatagtaatttaaggaaatgactacagaataataaacatagttgatgcaatttttatagaatcagagctcctatttgtacctatacatgaaagtagttaggaaaaatggactctatgtcgtggaccttttggatggctttggatttgcccattagcaatagacttgtgatctattttgtcttattttacaaggggttgagcaaggccttacacacattcagcatggcactctgacccagatcctcagataatactcccactgtgatgaggtcttattatgatttggtggtatggtactaggtatcttatcaactcagggccctgcactctgggggactcacgtatacatatttgtaggatgacgcagtatttaagactttagcatccttgcatctgacttaaggctctttctcttcaatgcagtgacttcaacagaagtggagtaaataaagatgatcacagaacttggaagctgacgaaattaattttggaaaagagctggcttggagcatgacagaagaattcgatggaaagaggttcgtggctttcagagaaaggcactgcccagtgggcaagtgtgggcattttacagcctaagtttatacttaacattcattgccctattaggtcatgaaacattctttctctcacccttggctctccagattaaacatggtattatcaggagtggcagcagctgcttgtggctacatagatcttgctcttgtgtttttgttttattaaggttttttttgttgttgttgttttgttgttgttgttgttttttgctttttgtttttgtttttcgagacagggtttctctgtgtagccctggctgtcctggaactcactttgtagaccaggctagcctcgaactcagaaatctacctgcctctgcctcccaagtgctgggattaaaggcgtgtgccaccacgcctggcaagatttatttattatatacgagtacacttttgctgtcttgacacatcagaagagggcatcgtatcctattacagatggttgtgagccaccatgtggtttctgggaattgaactcaggacctctggaagagcagacaatgctcttaacctctgagccatctctcttgctcttgtcaaaaaaaaaaaaaaaaaaaaaaatatatatatatatatatatatatatatatatcagctttagtttcgtatcggtgaggctacagactttctccacctatggtgagagagctttgacttgaggttccgtgcccactagtagattagagaacaggtagtgcgtggtgaatagtgggtggtgaatgacaataggcaacttaagccctgggaatctgcttcttgtcctttgtgaggtttaagctgagaagagctttcctctcaagaaaaaacaggaaactgagcagttttggctagtgctaccaataggtataacaggtttgggtcgctgctgaattgctggatttgagggttacttcttatgttaagcagctgaaatgctgtaaacatacagtacgatgccttcttagaaccatgggtatgattggggttctttctcctgtgacatctcaccttccaattattcaatcaactcagcgtcttggaggtaggatactagccattgctgataacagcagctgctgtttttcacttactatacaactgtcaaggtgatgaaattgtgaatggtagtgcttggtccagagcccagttttgtgaatcatatactgtctaatgataactaattgaagatttgggactctttttgttcctgagatacggttgcttaggctggccttcggactttcagtccttttgccttagccttctatgcaattaaaagtttatatataccattatgtgttctgttgtgctgtttttgtcacgaatatggatttatagaaagctcgccaaggagtcatatttgtctcccgttcaaagatagggctactgaagcctcagaggaaagattatagagctcacagacatttgacaggttggtgtagttactatgtacttctctacccagattaatttcttcttatctttttatagtgctgggagcccaactcaagactgatgtgtgcttggcaggcagtctacccccgatctcagtcctccagcctttcggccttttttcctttttggagacagaattgcatcatatggcatcctacacagtcctgcctcagtctctgcagtgctgggattgtaggcctatgccacctagcctttctacaatacaaacaaatatgaaaagaagagggacttctttggaaaggagtacagggactatggaagagatgaaaaggtaattggggaatatgatcaaaattactctacacgtgcatgaaaatatgaaaagatacaatttttaatgcaaaagtttggatgatgagaataaaaatacaggcctggaggggtggctcagtggttaagagcactgactgctctttcagaggtcctgagttcaaatcccatcaaccacatggtggtagctcaaccatttgtaatgggatcagatgccatcttctggtgtatctgaagacactgactgtactcatgcataaataaataattcttttttaaaaatatactgcttatagctataaatattagatttatgtatgtatttccttatgccagggagtaagtcaaggtttcagactacccttgaaacaagggaaggagggaagggagtaaaagtggggaatctttgatagatttagatgtctagatgccaaaggaggaaaaataaaactaacattgggtttcaaacttgactattccttgtcaatttgtttctttttcctctctacagataatattgtcagaaattatgccgcttttgaagagataaactgaactcttgattctgtgaggttattaaagaatattaattttcaaatcacggtaaaatcttggtaagtgactcagtgactctacttggcttgctcagttaatgagagcagaccagaaaggaggtcttaactaagcatcaaacaattactccacagttacccgttgtctggaaacacattgaaatagcttaccctccctttcctcatgttagacatttatagatggggaaattggaaattgtctagtggaagatagatttgattcaatctagaaatggtggtgtattctctgctaaaagatttttattaaagattttgtgtgtgtgtgtgtgtctgtattaggatctcaatatgtagtgcaggctggtctaagacatagcagtccttctgcctcagtctccctatccctggtaaaagcctgagctaccactcttggagtataacagattccaagatcatactttttctgatgatggtacttaaaatattatttgttacataacaaatcatctgggatgcttgttcaacatacagattgctgggaagttggaattttgtcatttgtggaatctgtcccttacttatactgaggttttctgcttagattcagcaacacatgaggataatcattgtgtccatggaaaccttgggaagcagttgaaagcctgggtaaggtgtcaatacttttgggtgaggtttctcattttgaaacaaaaggaaagtggttccatgtggcatttccatccttcttcaatagatagtatgtgcttacctgagattattttaggtgttaagaaagccctgcccatggggctggagagatggctcagcggttaagaccactggctgttctttcagaagtcctcagttcaattcccagcaacctcatagtagctcacaaccatctgtaagggatctgatgtcatcttctggcacacaagtatacatgcagacagagtactcatatacattaaataaataaataagtcttaaaaaaaagaaagaaaaagaaagccgtgcccttatgggactttcctttttgtgggttaaaaaagagagagagttatatactatatgtataatagagcatatatattaaattgagtttttccctttatgatttgaaaaattacattgaataaagttagccaaaacatagttagccaagcatagtggctcatgcctgtaatcccagtaggactgaagtaggaaggttaccagtgtgaggctatcatagtcgacatagcaatcttcctgtctcaaaacggcagcagcaggtgcctgagttaataatagaagcagtgtcttctggtttcctcgcttcctcctttctactgttttttctgtttattttttaaacttgacagtccctcttgcctggagcattaacacaacgtggctgcaaagttagtcctttcccgctaccatctcctgaatactgggactaactacacgtatgcacgaacctgcccatctttgcctctgttaacagctgccactgtctcttcacgacatgatggctgacctaggtgagtggaaaaatcataggtgtagggtatcttttcgttgcccctcttttggctagactccaaacggctttttttttcttgggtgctacacggggttttggacctactaaacaattcctctaccaatgaactgtatctctggctctagggaagatatttttgaaaaagggtttagcgtttgccagatcctatgcgtgagtgacctcaaaagagaagaggagggtacttctcaatgacaaagcagtaagtagagaaatacaggcctcactttttgttttagaagtgccgtttctaagcacaagtcagttgacacgacagatatcctcaaatggtttggggagatcatgtccttctcaacctgatcaacctgagggccagaagagctaaaatggctcctaaggaacggaagctgggcaccagaagctcctggtctgctttgctttggtttggttctgtgttgaggatgtacctagtgctcatcttggtgctctgccatcgagttataccaccagctcccaagctcctgcttgatatagaaggttttattgaaacatagtcattttcatttattactgtctgtggtcttttgtgctactgcctagctgagtgattgtaccagctatgtggcctgtagagcctggagtattaccatttggccttttgaggaagtttggccattgccagtgtaagttaactcctctccccattttatttctatggtacttgcctttacaacggatcctacaaattgaaatcagtttcttcctgcattgcttcccaggaaaattaagatcaagaatgtatattggagagccgggtgtgatggtgcacgcctttaatcccagcacttgggaggcagaggcaggcagatttctgagttcgaagccagcctggtcttcagagtgagttccaggacagccagggctacacagagaaaccctgtctccaaaaacaaaaacaaacaaaaaaagaatgtacattggagaggcgagagagatgactcagtggtttaagaacactggctctttcagaggtcctttgttccgttcccaccaaccacatgatgactaataacatttataaggggatctggttggtgtccttttctggcatgcagacatacatgattccacaacactgtatacaaaataaaataaggaaatcttttttttttaaaggggagaggggagtgtatatcgacagagcgggctatggttgtgccctcctgtgatctcagcttttggggactgacttctcgaagagtaggagaacaaggccagcctcagtcacatgagacccatctgaaaaaatacgaaagcattttcagactggatgtgaatacagaaagagctcttttatatgcctcatggagccaactaatttattctctatggctctcccctttctcttttcccctttctttgcatggatgccttttaaaatccagtttttgtttgtttgcttttggttttgagacagtgttatactgcatagccttagctggctggaacttgctctgtaaactgtctagtctcagagattcacctccgtcttgcctcctgagtgcccggattacaggtgtgtaccatcacacacagccttatctggctttttaaaaaattaagaaattactataacatgcgttcatgcacgtgtaatgtgataggtgagctttttattacttgatgccatttattgagcatctagtatgaaacttagacatgttctcttgtgaaattttgtcccaaaacctggaagagttgccatttccatctccaaaaaagatatatatgtttttcaaacatatataactttaccctgacgcactgctataaggtttggattttctttttcctttttttttgtcacttgttttttaatccttcaatggtattgtgctgtgttgtccagactggtcttaaattcctgagttcaagttattgtggctttactcatagtaggactacatacagtgaacgcacaacactggaataatagaattggaatttttggtgttgttttgtttcttttgagagagggtttctttctagtcctgcctatctcagatctcactctgtagaacaggctggcattggattcatagagctctgcctatctatgcctcttgaagggtggaccaccatacccaagttaggattggatttttaagtgtcttttgaaagttgtttcctgctttgacatggggattctttggagatggctttctctctctctctcttcttttttttgggatgctgaggatggagccttgaggggggcactgtggctgtgacccccttccccgttttcttcatgagcagcactctaccttgttctatctgccatggtgatttcttttttgctgtaggttggaaggaacagagccagttggccatggactgaaacttttggaactgtgagtaaaaagaaacttgcccttcttttaagctgtttgtcgctggtattttgtcatagagacagtagttactcgccatagtctggtttctaattaggggtagaattagatgttaaaagcatcatgaaaattgtcattttctttcttctcttcacccccatgctgatttaacacagggcctctttgtaagcagcttgctcttatcactaatctatatatccacggccgctttcgcccttgcggttctagaaattgaacctagggtgccacacacatgctaggcaaacagtctgtcactgaacttagttcaaagtctactctaccaccccagaatggtcagatgtatgtacgtgtgcatgctttaccagtgagctatacccacagccctctcatttcctttaaaaaaaagttttaaattgttattttatgtgtatgagtattttgcctatattgatgtgtgtaccacatgcatggatagtagagtccagaagtgggaaaaagtccccaggaggaatggccagtattcttaaccactgagccatcttttcagcactcccaccccattctgctacactttttatttaagtatttgaagtttcacagtgtgctggagagatggttcagtgattaaaagccctgactgctcttccaaaggttctgagttcaagtcccagccaccacatgtggttacttataaccatctctaatgggatcagatgccctcttctggtgtgtctgaagacagctacagtgtactcatatacataaaataaataaatcaagaaggaggaggaggaagaagaaggcgacgaggaaaaagacgaagaacgtgttttgagacagggatcttggttaattgcccaggcttccaatgaattcactctatagcccaggcaaacttatacttttgtttttcctgcctcagcctcccagtagctggaattacaggcaattacaagcctttgtcaccatgcttgacatcttgacattttttattttcttgttgacactgctggcatgtggtcctagggaccttagggatactagacaagaagtctaccagtggacaccagccctattacattttaaaatcttagtgggtcagaacacataaggacctcagtttctgttctcaacacctacataaaaagctggctatggaaggtagagagatggctcagcagaataaaaaagtcttgctgctcttgcattggataagagttcggtcctaatgtccaggtcaagtttcctagaactccagctccaggggttccaatacgcttctagcctccatgaactcacacatacgtatacacataagagtaaaaccctagaaaacaaagcctggcatgaccatgagtgcatgtaaccccagggctgttgctgacagacatgaggaggcttgttgccactaagtctacctccaggttcagtaagagatcctatgtcacaagaataaagtacagagtaatggagtaggactagactcttagtcccctggcctctacatgaacattgccctgaatgcctatatgtataggtacgttacatacctgcatatatatgtatatgtagaaaaatataatattcagaaatccatagctgctaatgggaatcaggaatcaaaaagccaattttaatatgttcctatgtaagtacctttgttcttcccaggcatatcatactgtctgtctgtctatctgtaggaatgactatcccttcttcagactcactaagcaaaagagtgacctagtgatgtttcagctaacaccattcatagcagtttctcttctatagtaccttctgtcaagggcagctacgaacacactttcttcctctccttatcttttctctcttttcaaagacatttatttatctatctttatgtgcatgagtgttttgcttacatgtaggtatgtgtactgtgcatgtgcccgatttctatggaggttagaaaagaatgttaaatcccctgaaacgacttgcagacagttataagcaggcattgaacctaggttctcaggaaaagcaataagtgcctttaacagctgaaccaatcctccaggtccctgtcctaatcttttgaagacagggaacagcttttggtttttggtttggtttggtttggttttttatttgtttgtttttcaagacagcgtttttctgtgtagccctagctgtcctggaactcactctgtagaccaggctggcctcaaactcagaaatctgcctgcctctgcctcccaagtgctgggattaaaggagtgtgccaccactgcctggctttttaattttcttgccttagatctttttttaagatttatttatttattatatgtaagtacactgtagctgtcttcagacacaccagaagagggaatcagatctcattaaaggtctctgtgagccaccatgtggttgttgggatttgaactcaggaccttcaaaagagcagtcagtgtttttactcactaagccatctgagatgccagcccccagggaacagctttaggtagtaataagcatggagaaacagaagagattaggaacttcccccaaaccctattttctgttttgttttaatagctattaactattagctattaggtattattttaatagctaatagtattaggatgactgggattcaattgtaggaaatgttgaaaattctgttcacattttagatttttccccccattggttaaccttgaatcattagcctgaaacaatcctactgctttggtcttccggttaattgggtctacaagtacatgcctctgacagtttgtacgtgaggtgagagtaactttcagacaagaactaatagtcataattggctaggtatcgtggcacatgcctttagaccttgtaccgaattgcagaggcaggtggtgctgtgaatttgagcctggtttacatagcaatttccaggccagccggagagccaaagtgagaccttgtcttaaaaatagccatggggagaggaagttttagcaaaagtatgccagtgtgaggttagaagccattctgcccttgcagtccatgagactattttctcgttagccagatcttaaaattcagtggcctcccctaggagggatcagtgggtaaaggtgctggtcactcaacaagctgacaagctgggttcaagcccctgaaagctagccaactcccacaagtcgtcttttgccgtctacctgcactgcagcacagggaacacccgcatatacaagaaaaatatcattgaaaaatgtggaagagtagcctcctatcaaggccattgtgccagccttgtaaaagaagaatgcctcactagattaagaaaaccatggcactgcaagaatttccaagactagttggtggttttgagattatttttttttaaagttagctttctgagtctttgtacaacttttcatttgtgtgtttgttttgtagcctgattagaaatagggtttcactgttgatgagactggcctcaaacttacctacattgcctcagcctcttaaatagaaaatgattctttctttttaaatcctctcgttttaccccatctccagaattgagtttccctcattgtttttattgtttgtttgtttttgtttttgttttttgttttgcttttttgagacagggtttctctgcataactctggctgtcctggaactcactctatagaccaggctggtttcgaactcagaaatctgcctgcctctgcctcccgagtgttgggattaaaggcatgtgccaccactgcccagcgaggttccctcattgttatgttttctgtgtgcaggtatatagatgtctgtctgtgtgtccatgtgcgcaaacggaggtcagaggtcaatctggactgtcgtctttgccttcttccttgtttgagaccagatctctgttttatatactactgtatacaccaagctagctgacccttcagcttccagggattcttgtgtctcagcctccgtcttttcatagagggcactggtatacagacagatgtgcacagtttttacttgggtctcttactttacagactcaggtgctcctgcttgcctagcaagtgcggttaccccctaagccctgtttctgcctcagctttctaagtgttgggattattggtttgagccaccatgccaggcttatatagctttccttaaattgttttttaaagaattattttatgtatatgagtacattgtagctgtcttgagacacaccagaagagggcatcagatctcattacagatagttgtaaaccactatgtggttgctgggaattgaactcaggacctctggaagagaaatcagtgctcttaacttatgctgagccatctttccagcccctcatcttgattaacatcagggataatactcaacgttggaaatcttcaactaatagagtacagtcgggggcttgttataaggcaagtctaggatccatagaagtagatcttgcttcaagaaaatgtaataagatgagagtccttgcattctttgggatcctcccctttatggtttctttgagacatgatctagttatataatgtagtcgcactaacattgagataaaaaagagagtcccctttcttatttttagttttttatttttcattatttaagtcttttattctccccaaagaactcaaattgtacttttaattgggatcttgtttctggagctaggtaactgaggtctcactcgtcagcctgctgcatggttcccttcccagacacatagatgccatccaaaaacttcctgatatccttgtttttaactgctgtggcttgctgaatcagagggactgaatttgaaacaagttcaatatcatttccttcaaggattaactcatctttctgggcttgagagacagaacaagtaacacttgtcctcatccgaacccttcggatggattttctacccaagaaattttggatttcaaccaaagacccattttcttggataacaacgttgatggggaagtgagcatacacagacctcatcttgtaacggaagcccagtgtgacatggcccttgatcatgttctgaacgtgactgcagatggttctgacagtggccggttccattctgttaccccaccatttgtcaacctggagcctttcatttttctttccaggaagacttagctccacactgatgtgattgaggtccccctggggcccttcacaatgactgtgcgccccttcagagtgatggcaacatcttctggaatgtcgacagtctgattgctgaaaatggtcttttttctcgtaggaaatggggcaaagccagaaccgatttgtactttttattttcattttattttttggttttcgagacagggtttctctgtatagccctggctgtcctggaactcactctgggattaaaggcatgcaccactaccgcccagcctatttttatttttttaaagaccgtgtcttactatgtcttaggctgcctttaactcagcatcctcaggccttcgtctccccagtgtgagacatgcctgtgctctgtaatgcccggcttttctgttactgtttttgttttgttactgtttttttttgtttttttgtttttcttctgttactgtttttgttttgcatgcatatattgtacattcctggtgcgcacagaaggcaaaaggaactatttaatcctttggaattacagcgttacagatgattgtgggtgctgtgaatcgaactgtgatcctttggaagaacatccgtgtgtgtgtgtgtgtgtgtgtgtgtgtgtgtgtgtgtgtgtgtgtgtgtgtgtgttcctacatacaacctgctcatgtatgttttcagaactgaccatttggtattagattaaccaattagtgtacccttccctagtgaagacttgctcccactcagggcatccctgtagttgattgcagttagttctctagggttgaggccttaggagttttcctctacttgattccctttcttccttccttcctttctttctgtttgtctatcttccttttgttttgttttgttttttgttgtttgtttgttttttaagacagagtttctctgtgtagccctggttgtcctggaactcactctgtagaccaggctggcctcgaactcagaaatcctcctgtctctgcctcccgagtgctgggattaaaggggtgtgccaccactgcccggcttttcttttttactttatgtttatgggtgttttgcctgcatgtattgcctgtgttccacgtctatgcagtgcctggtgagagctgaagatggccttagctctcctgaactctatttacagatagttggtgggcaccatgtgagtgttgagattctaaactgggtcctttgagactagcaagtggttttaactgctgatccatttttctagccctgaatcgacttgcttaattttactgtaaagataagatttttttctgatcccataccgctcccttggtactagggattgcatgcatggcctcattcccagacctattttcctttttggttttgagacagtctttcagtagcccaggctggccttaaaatttttattttccttactactttgttttacccctttaataataatatgtgatagaagcagtttaagaaaggtggctttttatgttgttttttaatttaatttgtgtgtgagttggttttctgctttcactgtataagtcccaagcatgccaacacatggaaggatttctttggcttaccgtgccagaaaatacagtctatcgtgatgggaaagagttaatgcttgcttcgcttctatggacgcttgtggtacgatttcttgtgccttgaagcagagaatgggagaggtagtaaggctcagttattaccttccagggtcttcctccatagacccacctctgccggctaggttccacttctaaaagtttccatagacagcatcacccccaccaaatcatgggttgtttcttgtttgtttgtttgttttaatttctaacactgtcccagtagctaagttcaggatgatttgtctttccgttcgactttcaggattctgaggagttaatgtttccatgaatatctcagaaggagatgtggacaaacgaacagttatctcactcctgtaggtaagtggttgatgagtatggaaggaatagtttactggtgtagtgtttcatgcctgtaatgccatcccttgaggctgagccaggaggatccaggcagggctgcataccaagacttcttaccaaaaaatgaagggggagaaaacttaccttttcttcttttggctgttgggtggtatttggtccactcagtagcttttctaagactgtgctagccttacgtttccagaaaaactccctactttctaaggattctgaatccaattttttaactttgctgttttttaattcatttactttttgtttaattcattagtgttttatttctaggttcaaattgcatttcggtgggggaatggttgacagtttgccatttttggatggactcattaatgttttttgtcggtttcaaattaaggagatctcaaacatatgtcatgccattaaatatcatttaatggcatcattttacaactgacgcactgtatccccctgtatgattataggacattaatttacatttctatttagacttatcacagatactgttctccttttctcctgggctctttttaagactgttacaagctaggcaaagatatttgcactgagctgtccccccagtccaaactgctcttatttgaatttatataaagcaagctacagtaattatttcctaaaattggatgaagtataagtccgtctagtaatgtgagagtagccatagttctacattgatactaggatactatattaagttgttttttgaacattcatcaattgtaagctgaatatgggggcatgtatctgtaatcccagcatttggaaaggctgaggaaggaaggaatattggtacaagatggaggctagcatactaccctgtctgatcctatgatccaaaatgcaaattcaaggagagagaatcattgtttcactagtcgtgaaagcagatcataatctcctttagtgttttactgtgtttccttgattcctaattaaaaggacaggtaaaggtgtttcttgactctttattttgaattttcgtccatttgattttttaaaatattcctaattgtttgtatctgtgaatgagagagaccaagtgctcacatgcatgtagacagcagagcgtatctttcaagagttgactttctcctgtcttattgacagtttctcctgtttctccccctacactagttagactccacgcctgctagtcctcatgttttttgtttgtttgttttttggtttggtttttcgagacagggtttctctgtatagccctggctgtcctggaactcactgtacaccaggctggcctcgaactcagaaatccacctgcctctgcctcccaagtgctgggattaaacgcatgcgccaccactgtccggcaactagtcctcatgtttactgctgtgcactcgaggctagtttgcctggcacttccaggcacttctgtaggggggctggggttatgggtggcttgtaccaaatccatctttttacatggttagcccatttacctgctgagccatctccctggcctttccttatctcctttgcagtgtgtggtctcaagtgtaaggcaattagagtgcatatcctgagtcgaaattctgtttgcttggttgacgtacttttgtgattttgacttttattggggtttaatgagtggaaaagatcactttgggagataattgcttcaacttggcttctttggttgtttttgagacagggtgtcatagcttagggttagggtgtcttggatctccttatgtattccaagctggtcacaaactcagaagttcttttgtttttggattaaggcttgaaccactggcttttattagctcatgtttcagaaattgtgtctggcctaacccacacctagttatgtagcttaagcattcttttctttgtgacacttaatatttttgtttgtttccttttctttgacacagtggtttgctatatagtcaagtccagcctcaaattcagaatcctgctttatcataacctccaggaaccagaattacaggaatgtgtcaccaatatgcctaatttatatttatttttcacgagatgagcataagtatagtttcccataagtataatttattcccataataaatgttttgttttgttttgttttgttttgttttggttttggtttttcgagacagggtttctctgtgtagccctggcagtcctggaactcactttgtagaccaggctagcctcgaactcagatatccgcctgcctctgcctcccgagtcctgggattaaaggcatgcgccaccacgcccggctgtattatatatttttgttttgaaatatttctaatgatcttttatcaacagagactcaatgtacactaggcaaacacgctaccagcttcagtatctacctagccttcacaaagtttttatcatagcttgtcttctgtggacactgggcttgtacatactaccgaagtaagtagcagtctaccattgagctatataatttccttcactatttttttttttatttttatttttatgtctttctttttttttcactattttttttaacattttatttttagatctcactgagttgttcaggcaatgattaaactcaactcctctataggatgcgcagtctcgaactagtgatcctcctgacttagactcacttctataccccaatgcctgtaattataaatgtgtgccattatttgtgacctatttcttgcatacagtatttatagttttaatttatatgtgagtggtttgtctacatatgtatgggtgtatacctcatgcgtgtctggtacctaggaagatctgacaagagtattgggtccttgaaagtgtagctataggtgtttgtgagccactgtgtggctgctggggatggcctctgcctgacagtgcccttccctgctgagccatctccccccacacacactgtagctagtgtgtccatgtcagcacattcaggcctgggggtgtgctaagaggctctgtgaagatctagtacagtgttcatttctaacatgaaataaaagaaagtctttgcatatgagcccagctctgctaacactggctttatgttctcatagagagttttgagttttcatacgacagtagtttcggtttgaggggccatatgggttctgctgttgtagcatgtaaacaaatctaggcagtgcatagacatgagtgcatttgtgttccaggagaacgatttgataaaaagtgagtgagctttatttgtgtccagtacctgctttattacattttgttcttatactctctgtaattatatttcaaatgttcacgcatctgattctctgctctaatcttttttatgtatgtaagtgaatcccacgtggacagtaccaaagatgttagaagttgggtgttagatacctagaactggagttacagaacacgggtcctctcctaagaacaggaagtgttcttaattgctgagccatctctccaacccctcctttgtaaattgctgggaggttttttttttttcttttaattgttgttttcttttctgaggctctggctctgtagcccaggcctggaattcactgtgtagctcagtttggcttccaacctgcagtgattctcatgactcaagcagaattcgaggcactaccacgctcaactggaacgctttgattgattcacttggttcagtccaggtttttgctgatgaccggtttccataacaggtttttgtttgtttttcaaagagcaaccttagctaacctagtagcttcctctttcattagctcccgtgcggggggctgtgaaagtgatctgttatattagtataattcccagtagctgccttccttttgtcctagcttacagtgataaaacgctgacggaaaacgtgaggcaggaaggagcttatataacttatatgtcacagaggaaagccaaggcaagaacctggaggtaggaaatggagagagcacgaaccgatactaactgccttgttcccctgcgttgctcagctatctttcttatccagcccaggccctcccaccgagaagtggcactaaccaccacaggtcaatataatggagacagttcttcaattgatgttcccccttcccaggtatgatacaaagcaaaataagctgtcataccatttgagagtgttcttgttgaaccatatttcattgtagaaataggcttaagtttctggagcttgtctctagtgtagtttcatgactgcttcagcttccatctggttctctgtgcatgccaccttgcttctagtgtatttgggtgtccccgtcataatgtagccttggcctcctgttgacttaagtcttttttttcactccttccttgagcttctgtggtctgtgggcatggccttcttactccctgcatctttctctatatagactgtttgctgtagctctcatcgctcaccagtctcgttggttattaaatctcattcctcttggtctgttacattcctgtgaacataggtgtagcagatcctatttgtcaggtcctaggatatttcctactattgcccgttatatgtgaatgaattttctctttatgtttaagtcggaaattgcttcagcccaaagcaatcaagctaatgtaaatataatcaggattgttcaagtactttaaaaccctaaaggcaacccagccctggagttgtatcatatctgactatctttggacctgcccatcacacagataattctgaaaccccattctcttagcattgtcttgctttctccctgctgctaacagacttccccatcctgtttacctggatgcgtggattctgcgtcttcatagctcttgagtcgttcctttgcacattccacacttgattttagctattttgattattccatggactttagtattttctttcatatttccatttaccccattagctgattttgtattcctttgttttgttgttgttgttgattgttgtttgctttttttcttttttcttttttttgaaacatagcatcctgtagcggtcatcaaagttgctatagtagctgaggctagtcttccatttctaatcatgatatctctgcctcccaaatatgagattaaaagtatacaccaccacaatacctaatttgttcatattcatttctttaataggtgctgggggttggacctagggtctcacacagtagacaagtattctatcattgagctatattccaagtccttgttttttgaaattgtaaattatatagaatttgtcactttgttcttgtttgaggaaaacttttgcggcatgacaaatcttaggctcttgaccaacttatggatacatgtccttgattctggtcttgtgtgtaggtgtgtgtgtgtgtgtgggtggtagtagtggtggaggtggtgggcgatctgaccctgacttgggaggatgcatagttagacgcaagaatacttgtctgtttgtttgtttaagtttccttaaatattggacatggggaacacttgctgtttttttgaattttgaatagatttaaaactgattagactgatttaaaccttcacgttgcagtaacttgcaagtctctcaatggtttactttctagtggacagaagttgttgttgttttatttggaatatagtttctcctccccctcccccccccacacaaactagtcttacattcatctacagccttggtctcctgagtgctgggatgctgccattatagacaagtactaccatgtgccattataggcatgtactacagggcaagacagtgcagcttttcctccatcttgtattcttgctgaggccatttcatgcttaactagaatttcatctccgcagtagagaatcctatggaaattcttggaacccaaggtcagaatgtcctagctaacttatcttaacttctcgtaaattgtctatttgtgctggagcccctccagctaacttatctcagtttctcttaaactgcctgcatatgcagaacaccctccgggtatatcttagtgactgttaggttaaagggcttgctccctgtaatcctagtccccaactgccaattaaaatgccagactgccaggatatggttttgggattttttggattttttttcccttcaaaaaccttgtgctctgaacactgggtgccagtgggaatgcagacttgcaattcactataaactgtctgagtagtcatcttggggctaccaataacctatgctagccctgtttgctcacttggttccccttcttcccttctcccctggcaaaatctagggtggttttttttcttcttctttaaatgttctttagaaataccagagaatgtggggctggagagatggctcagtgggtaagaacagcaactgctcttcctgaggtcctgagttcaaatcccagcaaccacatggtgactcacaaccatctataatgtgatctgatgccctcctctggtgtgtctgaagacagctacagtgtactcatacataaaataaaattaaaaaaaagaaataccagagaatgagtcatactttgccactgagaaggactgtagctcaactggtagagtacttgtctggtatctgtgaagacctccgattaatccaacacagttggggttaggggtagcaaaaagaag

SEQ ID NO: 47 - DNA, 252150 bp, Mus musculus; identical to SEQ ID NO: 33
  misc_feature (222949)..(223540): n is a, c, g, or t
  misc_feature (242091)..(242091): n is a, c, g, or t

SEQ ID NO: 48 - DNA, 214384 bp, Mus musculus
atctttaatttcagcatttctgattggctagacagactgcccaatctgaccttcctcaacagttctgtgattacagccgttgctgttaccatgggtgctggggatctgaactcaggtccttatatgtgtgagatagtcactttacccactaagccacaccccccagtcctttggcccatttttttgtttttgattttttctttgtttgtttttgtttttgttttttgttttttcgaggcagggtttctctgtatagttctggcttcattcttctttccttatcttttttgaaatcgggttgcatatagccgagactggccttaacctcaccatatagtccaggttgtccttgtacttctgatgctcttacatcctcccctgatccttgaatcttcaccttccttgttctgggattccaggtgtaagttaccattctcacatcttctctttttttaaattactaatttttttttacattccaactgtagttgccccctcccggatctcctctcagtccagcctccacctccgccccccatccattcctcctctgtatatattcagaaaagagtaggcctcctctggatatatatcaaccaaacgtgacatcaagctgtagtaagactaggcacctcccctcatacacccccagagctcgtgtctctagctgcatatgtagcagaagatggcctagtcggacatcattgggaagagaggccccttggtcttgcaaactttatatgccccaatacaggggaatgccaggtccaagaagtgggagtgggtgggtaggggagcagggcggggggagggtatagggaacttttgggatagcatttgaaatgtaaatacaatatctaataaaataaataaaaaagactgacttctctcatcctgtcttcaaagctctttctttttgtgtgtgtgtttttttgttttgttttttggagatagggtttttctgtgtagccccggctgtcctggaactcactctgtagaccaggctggcctcgaactcagaaatctgcctgcctctgcctcccaaatgctgggattaaaggcatgagccaccacgcccggcttcaaagtttttttctattttgttttcttccttctttccttttgtaattcttataatgttcatgttgacaatgtcagtaatgtgttacaggattcttagattccgttcaggttatttttcttccttccttctttttttaaaaatatttatttacttattatatgtaagtacactgtagctgtcttcagacactccagaagatggcatcagatctcattacggatggttgtgagccaccatgtggttgctgggatttgaactcaggaccttaggaagagcagtcggcgctcttaaccactgagtcatctcaccagcccctttcttccttctttctattgctcagaatacatcatttttgttgttgttattgttgtttttgagacagagttactctgtgtatggctattccggaacttgctcttgtagtcagaccaggctgagcttaaactcccagagatatacctgcctctgcctcctgagtgctgggattaaagtaccatgcccagctcagactacagaatttaactaatctagcttcaaggtcactaattcccttttccatcacttcatattagtgttgaaaccttcttagtaaccaggctttgtagcacatgcatgcgatagcaactgtttggaaggccaaggctggaagactaaacttaaggctctttagagctacacagtgaaatcctgtctccaattgaagaagaagaaagagaaggagaaggaggaggaggagggggagggagagggggaggaggaggagaaagaggaaggttgcagcttgttggggttgtagcttaggtagaacatttgtgtagcaccatattacctggattagaactcagaactgcaagaaaaaaatcgtctagtaaatttttgtgtttgtttttaagaaaggatcatgtagctcaggcttcaaattcactgtatagctagctgaggatgacctcaaagtcatgatccttctgcctttatcaacctgaatggggagaataaaggtatgaaccattatgcctggttctttttgttgttgttgttttttcgagacagggtttctctgtgtatccctggctgacctggaactcactctgtagaccaggctggccttgaacgcagaaatcctcctgcctctgcctcccgagtgctgggattaaaggcgtgcgccaccactgcccggctcattgataattttacaatcagttatttttattgaaaattgaatgctcagaatactggaaatcagattttcttccctcctcaggcattacttgtgttctttgcagtatatgtagctgttgctatttatttaattctgttctaaaccactgttttatagtatttattttatcggtgtgcctgactgtatgtattatactacatgttttatatgagtccgtggaagtcagaaaagtgtgttgcataccagagatgctctttatttctctctctgtgtctctctctgtttgtctctgtgtgtctgtctccgtttctgcctctcctttctggcactaaggaatgaatctagaatctctcagtgctctaccactgagctaaatcaccaaccccctttgtaccattttctaaacttctctttcaggctagcccagtgtcagaaaaggttgtactggaagaagaggagagacattttctctggcttttggaattatcaaaaatgtttgcttaaatacaattaaaggcaaagagtttcaacagtctatgtaatttgagtttattgttttgtagcaattatctctcacctcctggagttccctcctgctcagggacatttcctgtggaccatgaagagaaggccttttaaaggcctttctgttttgaaagggactagagaaatgattgacagtttaagtgtctgtctcttcagatggcatttgtgttttaattaggtagctgcagactagagtttcagagatcagagaaatgaaactcaaaatccatgttttacagacaaggatgacactagagctctgaaaagatgaggccccatggtcaactcaggaagataagaggagtctttaagaccaaagcaataactctcccaatggaatatttaagtctgaaaaaataatgagagagagagaaggcgggaggagagggagaaagggagagagagagagattgagattttctgtaaattttggaaatgggtgaaagcatatggggcctccccaaacatgttaagagggttaaaactaaaataaatccaaaaaacacttaagaaacaaactaatgacatcatagtctttttttttttttttttttttttttttttttttgatttttcgagacaggtttctctgtgtagccctggctgtcctgggactcactctgcagaccaggctggcctcgaactcagaaatctgcctgcctctgcctccccagtgctgggattaaaggcgtgcgccaccacggctggctaataccattttactatgttcctttactatccatttacaatattttcctggatgacagacacacaatacgggacttctttgctttgcactggtgttcggaagatttactgatcatatactcaggtctgcagctacatttcaaacctattaattagcattatatgagacactcagtaattgtcaattatttgtgtttctcctcagtagcatattcaagtatgaaaatgagagccagaaatacctacttgaaggactaaatgtaaatcacataatatggctatttctattgatgaaactctaatgagttcttacccatttgttatcaaagttgtaatctgtaattattttgcagtgttttggggggtggggtggggtgagatgggcagggtctcatgtaacccaggctgtcttcaaactaattatatagccaagtatcttctagtctccacatcttgagttctgggattacaggcacaagctactatgccccatttatgtgactctggagactggacccatagcttcatgctaggcaaacactatgaattgagctgtttccagtccctttgtagcattcttaatgagtaagtggcaaacaagaagttgatgggttttgatgtatgtaaacatacccaatgctttgcagactgatggctacctcttaagtgttcttcacacaacctttcaatgtatttctcccttctagtcctttcttcctgactccccttctcttcttgacttggcttggtaacattaaaacgtttccaccgaacaagtggccagttgcctgcatctgagtcaactgtggaaaactttccttgggccttacttcctcctgtatctggaaataagccaggtcctcccagtgatcgttctttgtagttgcacacaatatctaagataagatcaggggtgttcagaaaaatatttgaagactggaacactgaataagttgcaaagactcttctgcagcgtgcaaactacttgaggatgggaaaaatagtatgcatacatttgaaaagtaatgaaaagaaaaatatccctccttaattcctcatttacctgactgaacccaggtgtccatttgttgaattttcatttctgccttgctcctacccaccctttccttattgaagctacttacagtgcaacctttgagctctagtgttatctttcctctgtctacacgcctccagtatataccactgtaatatagccataaaagtaggggatgtatcattttctcagcacccagagaattaacaaacacattgtttggagagaaaatgcctttaatatgctattaagaaaaaaaattcagatgtttcagagtctagagtagtggagaaacagcaatagctttacagcaagaaagggcagcttccatgtaaatgtgacagttaccaccaaaggtgtgttttttgtgtattaggaatgaggttggacttcttattgcagacagatcatcatctatctgcagagaggtcctcatcagcattcttttttttttttatagtatagaatagagtttattcagggcatggggagcggagtcaagagggtagtaaaggcagagaaagggagggagggaaggagggagggagggagagagagagagagagagagagagagagagagagagagagagagagagagagactgtccatgagcaggtagagggtcagcaagggaatggggagagatgggggaagggaaagcaagagtctcatcagcattcataatggccttattttctatctttggaaaatggcatgatgctcacacctcattttgctcatcagtaaaatggatgattggtatcttccttattggaaggaatatacttccacgaggtcagggcagaagtggaagttttttttttttttccttaaatctttcagcacagattgctatttcctcagtaggagccatggaaccacgaaccccttttctgacatttcctttagggatgggaaaatacagttcttattttcaatcccccagcaagtaattgtgacaccttgtctttcaaagggagatttaatctttggccattttgatgtatgcagtgtgccaacaaaaaagccccaggccaccctgctcactgcagcacctttgcttacccagacctatgtgtttttaggtggtggactgctttctttgagaatgcaagggtgtttgttctgtatgttgaatatctatctgtcttgctagcaactcagttaacccagcctatatcattctagtctgacttcattgttttgacaagatttgaaatagataaatcttctaagttctatggctaggtaattgatagcatgtgagtattattcaatgggaaaaatgatcttcatttaattaaccaatggcaatagatttgtaatcacctcctgatgctgttttacaaagttatcttgtaaaactggttgttttttaatttcttcgccaaaagatacctccagatagagaaatttatgcttactttactcctattccctaaaaagaccaaaatcaaataacaaatacaagagcatatgcacaaacaagtttctgaaattgtgaacaaagtttcaagggctcttgagtctagactttaaggagcaaagcttttcacacagctttttgcccagcccccatatgacagcatggaataagagtggtctggggatggtttctgaatattagagtcttctgaaatatctccaactcatcgtgtgtctacttgtttggaattgtgtcttgtaaggaattatatccaatctcaactgccctgctgttagcttagaggccaaagagacactgtaacaggaaggatgcttccgtttctctgctcctgtttcattcagaaactatgacctgctgtatctcgattggctgaaatccacggacagcagatggagtggtgaagaaagcgttaggcagttctccggggctgatggagccagagtcactttgcacggaacctccagtgttctcaaactgggagattttcttttttatcatcttcctctccttggctctgcgattctgaaaccagattttcacctgaaatacaaaatgctttatacttaatgggaacaacaccctaagtgtaaccaacacagcaagtgcagccttacaagcctccttcacacacatcacttcatttgagccttagggtgactttgcctataactatacccattttacaggtttgaaaacactgtgtctcagaaagagaaggtgctttgtaagagatgagactgaagccatcaaacctaggactaccgactctgaatacagagctatatgtattacaactcatttgcatcctctgttacacaagtagaaataattatataatgatgctgaggaatgttgatgaaagagaatgatttaaatggcaacagtgattacagttggccattaagaaaatttttcttatattaaaaagttaacaccgagccaggcgtggtggcgcatgcctttaatcccagcaattgggaggcagaggcaggtggatttctgagttcaaggccagcctggtctacagagtgagttccaggacagccagagctgtacagagaaaccctgtctcgaaaaaccattaaaaaaaaaattaacaccgagaactgggtgaacatggtcatgaaataccatctatttcttgttgtaaatcaacacgagagtggtattaatgcgcctatacgtggttggaatgcaaactgcttgagataaggcaatgcattaatgaattttacatttctagacttctatgattccagcatcattcttagacttagggaaaactcaccaggtgctcgtgtaattgccaagtctgaatgagtggagactgctgccctttgctgtaagttgatctttattgagtatttacaggaagctaaattggaggcaggcatcataacatcatacagaccagagaaggttacatttcctattttgaataacagaaaagctccatccacagaactgcactgatatgtagttcctcttgtagtttgactgataggactcagacagtggccacagttgtgaaatttccacttttcacactcgttagtactacttgagggaccagatcaacgtttgacttgattgatgaattatattggacttctaatctctttgcacctctctgcttgatctcttgctcccaggctcacaaaatacccacccattaaatagctaataagtcccctgatcaatgaaacaacccagggtgagtatgggtttaggagcacttagaaacgcatctgtcttctgttttgctatttcctccaaaccctagccgattgaaataactatgtgggaatgttggtaatacctgtctctcagaaaggcccaggttaactgccagctctgacttcctcctgatggtgatgtatctattgcagtgaaattccttttccagctccagccgttgatgatctgtgtagaccacacgatacttttcttttgtcctggttttccctgttgagaaagcataagatttcatcttattcttctcttctggagattatttgggttgagggcaccagttactcttctaactttcatttattactttgaaatagaaaggaattgtatttttaagctaaatatatcatgtcaaatatatcatatcatgttatcaatacctacctgggtgtgaatataaacatccataattgtcctgaaataatcagtggaattacagctactctacctactgttatacaaaaacatttaaaatatttaaatactcaaccacacagttttcatccaaatataataattgaattaacaataatggcaacagccaccatgaattatactttgctttattgttgttgttgttgttttgaggtagggtttctctgtgtagccctggctgtcctggaatttgctctgtagaccaggctggcctcaaactcatagagatatacccttctctgcctcctgagtgctaggactaaaagtgtgcaccaccatagctggccttcatgaattacattttctgcaatgctttcatgactgtttcccattatcttatctactctgttaaataacatggagaatgttattgtatagacaaagaacctgaggttcagtataggtaagtgaatttgtgctggtgagcctaggagggcaaacccaagcatggacctttgactctaggcttagtatgctgttgggaagtataatcccacatgaagcaaactattctggaatcctgacattgtagttctgtgtattacctagaaagactttgtatagtttgaaaagaaaatatttaattgctacttagcaaattatgtttcaaaatggcacctaatgtttattagaaaaagtactatttttcctgtgggaatattaaggctttttttatttccacgtgaacagtgaatgggggaggagggtgtgttgacttaagcagactgaagtgaggactccacgtgctttgaaaagatatccaaacatttggtttgtgtgacaacatctagctaatttctcatgcttgcctttaaatagagttttagtcttcctttcaaactttgcaaaggtgattaggaagtccccctttcttttcagtttctctaacccactctaggatctcgctttttttcccctgtggcttttagaaagttcttctgatcttctctggttgtttttgatgtgaggttttgcgctcacccccccacctgtaggacaaagacctctttaaagtgggtccctaaactccattgaggtgttaagatgcagcacaggcctaacaaaggagccacatagcatggatcccatcctgaaccctctttacattcaggaacatcaaccaattggcttggaatttacaagccctaaacaaatgtcagacaccctttcatcttcaggaagaggagggggcttggatgtagaaacagatctaccttaggattcaactgaatggctagataacttatgggctactcagtgcaactaaaattctttcccttgaaatgatgagccccaagtcccagccaattaactttcctcaaaggcccaaacttcgatccagatttctggatccatgcagaaacacaggaaaccagggatctggcttttggcatctttcaaagacagcatgtatactgaaggatgaaaacaaaaatctgaggtttaattggttttcaggacctcggttttagaatcaaagtatatctttgaggagatagttcctaaaacccttcctgatcaaaaaaaagggactgagtttaaattttaacttgaaagaggaaggttaaaattcaacttgtgtgtgtctgtgtcttcagttcagccaattaatcagtaaatataaccagacttcaagaactctggaaagattgtggtccttcccaacccccattggtcataaatttccctcttgtagtttcttctgaggacaataaagtcaagaccaggcctctttatttgccatgaaaatgctcaccctttccggcaatataaccttcgaagaaaggggtaatgacaagagctgagatgcatatcaaagctgaacaagtgttaaaaagggtctgtaggcccaatctgatgataagacggaaaaccccaaagacaagggagtatactaactacctgcacagtttacaaagggaaagaaattctcagaaccatggctctttccccaatagccttttcccctgagatgagtgaagggatctggccactttccggtagaacacaatgtccatattcccacactaaaaccaaagaccaacaaagcatgaggaggacttgtttttattgtttaagttcctctattttctagagacaatgacattttgagatcaggggatttccttctcagccgatactatgagttagtttaggaatggaagaaagtctaagatttattaaagagctacttccactcctctgaaatgagaattttgttacttcttccacaaagacttgaacaatcacctccatagttcacaatggtccttcctaccacccaggaggcagtacctcacagttcacaaggagatgtcactatataggatgacactgtcaccataaatgtggttgaaatggtgttctgtggagagactagcagccaaagaaatattaggcagaaaagcccatatgaagcctcaggaccacaatggtgatgagaacagaaacaaaacaaaacaaaagaaaacaaaacaaaacaaaacaaaacaacgatggagacagtaccaccgtgatgacttttcacctaatggcaatcctttactgctttttaactaaaaatcacatccaaactcacttttaaagttgtctaacaaaatatgaaaaaccaaggaagacaatgaccaaggcctcaaggattattaagcagttcagtttatgaagtatcctaactgaatacaacttttaaagtatttccttagtggccagtggtttaaatagaattgctcaaatgacttcctttccttttgtaaacagggaagcctctttccagctgtgctaagcatgcagcttggccaatactcatatagggctttagttctgtactaaagaaaacagtggaaaacgacttgttctcgtacactggcattgtttaaaatgtgagactgcttgaaaatattaacatttgtagaaatgtttggataagatagattgcgtatagtggcatgtgcttagaataggtttattctacatgtctatctccatgctttagaaatcacacctgaggagctgaagggatctgcaaccctataggtggaacaacattatgaactaaccagtacccccagagctcatgtctctagctgcatgtgtagcagaagatgacctaatcggccatcactgggaagagaagcccattggacatgcaaactttatatatgcctcagtacaggggaacgccagggccaagaagtgggagtgggtgggtaggggagcagggctcagggagggtatagggaacttttgggatagcacttgaaatgtaaataaagaaaatatctaataaaaaaaagcgaaaaaaagagagaaatcacagctgtaatgagtgctacacacacacacacacacacacacacacacacactcacacacacacactcacacacacactttaacttaagtctgtttcaattatcttcattaatgaaaaaaagagaaacaaagctttaatgggattgctttaattcagggaagggttattgctttaatccagtctgttgtccacagatttttctctctctctctctctctcagccctaaacgctatgtccatgtgcaatggtaggaggtgaggagaaagcttaggaagctctgacttgtccgttcacttaacagacctttaacatctgctcccttgctaatataaaggggtatactttggtttggagtgttcaatggggtgatgacattgatttttgtggagtttaaggcccaatatcatgaaagatattcagtgagtctagaatttccagaacttatgaaaagtatcacttatatgtgtggggtgctctcatcttaaactgttgatgaataacaacctgaactataagaatatgcaaaaggatggtattaacttacaaggaattcaaatgaaacaaatgttgatgttaacaaaactttgcctataggacaagttgccaagagtccaaggagctataacctcattctcagttttgagcttctactaaacatggaagagaggaagtaacacagagtagatggggggatcccttctcaacttctcttggcatcagaattacccaaagaaggctctgagatatatatggaagacttaaagcaaaacagagaaaactgtcatgtttcccctcagcaacacaaagacaaatcgtcacaactgaattttcttattgtgtcattttcctcacattgttttccattctaaaaaatgtgctagtgacatttccccctacagtatttcaaaggacaatcctagacagtaggtatttttatgtcctttttaaaatatgtattttgcttattcttaggttttagtgaatggatgttatttttaccctgaagattagatgtaacaacagttctggggatgaatgccctaccctagccttattattattttttaaagttacatgacttatccatattttcttcttaatataagttcttaagtgttacttttaacttgggatctctaccctagttataaaactggagcttcctccttctggctgaaaattctcctaaaggtaaaaaaatgttacctccctatcctttcacctttgctttttggaagagcgagaagggaaaacacatggacaaatactattgaaatatcattgcctccccagaggggtgaatgtgatagacaaatgtcactaatgtcctctaatgacagggaacaagtattggaataataagaaaatgttaagagaacaaccacagctgtaaacaaacatgtcactggctcccagtctaagaattacagtggagtcttcatttcctctaagctcgcgcctccctccccaccagctagctgctcccagttgcccgccagggcttattggtcagcgacattagaccttaaactggggtccttacaccttttagtgttttgacgctgtcgcagacttgcattctgcttctgcatttgtggccacctgctgaaatagctatgagagctttaggcacttagtggcgggggtgggggggggagataataatacttggaacagttgggttgtgtgcctggcggatgtaaggattgtgtcctatgaaatgacagctcagttctgtaaccttgttcaccttaacgcttccttcggttggtagggacattggaataggcttcaagacatttctaatttgggcgacggaagatgtagcttccttaggcatcttgtatcgagggccgttttttgccttggaagccttcttaggctcggccgtcggttgccagctaagcacctactaagttgagcatcacaagttttcagcgaggctgcataccgcggtagggaaagatttggagataaaaccggcaagcaccatgacaaccttagctgtccttcaccctgttcatcatgatgtgcttctggttttttccctccggacaacgacaggattggatcccgatccttgtggttcatcaggaacactgtccatacccttactcccttgacttatctggaaagggtaaagccaaaccaaaccaaaacccaaccaaccaaccacctaaacaaacaaacaaacaaacaaacccacctcaacaacccccaggagaggtttagttccaagcgctacttttaaccggctttgaacctaggcgcaaaggagggaactactgatcccatcagccagctacgctgtgggctgcttagttgaactctcctacggggacgtagagtgaagagtaagagggtagcggaccaagggtagagaagagaagaaacagcggaacgatggattactcacccgtcacctgcacagttttgcgcatccatgcgtaggggctgtgacggctcctgctgggagaagtggcgcctgaggtgccggagtcaagagaaaccagtgactcgctggccgcgtctggcaagctaccgccgttgcttgcaccgctggtggggcccagagtgctgtagtctggggatccgaaaactggggaggtcatgtcattcatgggcactgtgcccattgtactgggcggcccagggtatgtactccagtcttcccggggcggactgtagggtgagctccaggctcccagcgaaggcccgtgaggatccatgttggacatatgagggtaacccacgtagtgtgggtaaactggggctgcagtaaagttggaggcaggcagaggactaccactgcccccagaggtgcccactccggctgtactgcttcctccagggctcctgagagtgcctgggtacatgcccgcttctttttctaaaaggcagcttccatacatggtgacttggatagaagaagttgccccttaagccatcctgaggtccctgtaaacttagcgccaacccgagtttgagacgcaagagactatcaacggtcagcactagtagcgctgctagctcctctgcgcggctcggactactccatccttcctttcctaccctaaatttccaggtgactggtagtgagccataggagggttaccaaaggctgggctgacgtcaaggggcttcaagcttttacatagcatttgcattcaaatgaagggccacttaacgtcttcttgttcactccaaacaccttctccccctagctcctagcccatcagcgccacttcagggactcttctggtttcgtagcaccacttttgcgcttttggaggcagttgttcctcaagaaatttctcattggcttcttcaaaatgagactgagaagcgcaaagtcttgcttcctttcactgaggcctgcctttccctgatcttccagagcccagcttgctctccaggttttcccctctgcccatactctcctgtatggactttccagctgttactggcccatcatgccactggcaaggattttcccttctctcacacacaaggagagggctttgtttctctggacagatagatatttgtttcacaaatgtatattcagtatccatagtgggtcaggaattgttgtaggcactgggaaacagcactgacatatacttctagcttcctaaagttagattccagttggatggaaggttacctaattagatgctaacaaatatgcacacattaaagaaggagaaggaggagatgaagaagaagaagaagaagaagaagaagaagaagaagaagaagaagaagaaggagccatgaaaaggggagagagcgcaagtgggtagtgcatactctgaacttcatagtaatgtattagtttccgtctgtcttcttcaaagtcagtgccctaaaggacaggaactcatggagtttgaaatccatggcagctacagcagacttgcaatttccttccaaaagtatgaactaggtaagcactccaccacctatatcccagacacagtcacccatttaaaaagaggagccccggggccggcgagatagctcagtggttaagagcgccgactgctcttccgaaggtcctgagttcaaatcccagcaaccacatggtggctcacaaccatccgtaaagaaatctgatgcctcttctggagtgtctgaagatagctacagtgtacttacatataataaataaattaaaaaaaaaaagagagagaagccctgactgcatctgcattataaagcaggattctcaaagatgacacctgtaaccagcttgactgctatactcattcactgaatacagtttttttgttgttgttgttggtggtgatgttttccagacagggtttctctgtgtagccctggctgtcctggaactcactctgtagaccaggctggcctcaaactcagaaatctgcctgcctctacctcccgagtgctgggattaaaggtgtgcaccaccatgcctggatctgaatacagtttttgatagcattcttgatcaggtctttattcaaataagttgtcaccaattatttgacccttatgacatagtacacattttaatagtttgtgcaacctgctcccatactccactccctttggtagacttctttttcctggctggtttcttttcagtgactgggttattggtagttgcagcttttccttctttcctttttacctttcttggcctgtggcccttgctctgagccgcatactctgcactctttctctgcagagccttccttacaccccttctcttgctcatctatgtaccaccatttctgtattcttctttgcacccctctctgtactgccttcccctgcaccccctctttgaaccccattctttgcacccttttgcatccctttcttctcagcctcttctttacagccctctccccatctgatttgcttttgttgaggcccctactttcttcacccagactttgtctggcttagtgaggactgtgttctgttgcggggtccttgtgtgtgggtttagttcaataagattcccaggttcttagtagattcttgttcaggagtctgatgaatcagtgtgtgttgtttgcagggctctttggctctctggacttctcaagattctgctgaggtctgtactgatcttcttgtacatgggaaatctatcattattcttgaggaaaacagttttaaaccaagtggcaaataattcacctaacttccagaaagcactgtaagtacaaatgtagctctcccatgtccaccaggagcaggagcagtctgctcacattaagcagagcaattccaaggattttttttttaaacgaagatcttgatgacaccattgtcttcattgtaggtgatgcagggtcccctgcaggtccaccacaatgacacttgctcatttcgctcttgccagctctcatctatgaagacacatagagcttttaaaaacattttcattaattctttgagaatttcatacagtgccttttcatcatattcatcccttccttcctcttcttccagatcaccccacctcctccttacctacccaactttgtattctctctcttttacaatttacttttattgcttttaagtgcatgtgtatgagtacatgtgtgtgtgttgagtgcaggtacttgaggccagagctggcttgatgcttctgaagctggagtcacaggtggctctaagccactggatgcgggctctagaaatccaattctggtcttctggaagagctgtatatgctcttaactttggactatctctccatcccttctcctttgaaaacaaaacaaaacaaacaaacaaacaaagaacccacaacaacaacaacaaaagagactagtttgtgttggtcaattactcttgagtgtgggggtccatcttgatgttgttccaagtttcaagtttcttaagttaaacagttgttgtggccttcttgtaaccttcactcttcagccaacaaagaaagttcaggaacttctttaatatgataacttctagacattaacacattgctaaggcagaggtagccaggtcacaacacatggcatacaggttttgggctctattcgctttatcatgccaacaatgccagacattgattgaggcacatgggtggtctcctcaatacaaatgtccaaagacatctgactagattagtgggttccaccacctgaacttcgagagttccagctgcagtttggccagtatcaggatccagcactagtctatgagttgctaattcagacagtacaaagctgcctattggttttctgcaggttggtttgaacatattcacagtatcttgttaaatgggaatcttgaacatagtggacatattcacaatttcatcccttttcagagtaaagcaaagaggaaacaaacaactcatcttattgaacagggaaaacatgaagatacaaactcttcatgaggtacacctgctcagcctcaggcaccaaagaattctgtttatagcagagcttgtgttccttcccccacacatatacacactcaagttttcttttaagatccaaggaaagctagtattccaagggttcttttgagaatgaccagcactcgctcctcctgggttggttcaaagcacagaagcccaccttgcctctaaaatgatgtcatatagtgagagaagccagtttcccaccagaaacagatgcattgcataagtcagatgcttttggttattgtttccttgtttctttttctcctgcagatttgtattctgtaccctttagccttgcctattggtcccaagagctggtgaaagcagtgaacacttccactcactgtagtagacagaggagaagaacaaatacttaagtactgggtactgaactgtggtaactgtggacacatcaccaatgaataaagcatctgaccttattaaacttggattctatatttacttattatttattgtgtgtgtgtgtgtatgtgtgtgtacctatgtatgtgttggaatgtggagctcagaaaacaacttgtagaaattgtgcttcaggctggagtggtcaagagcactgactgctcttccgaaggtcctgagttcaaatcccagcaaccacatggtggctcacaaccacctttaacaagatcggactccatcttctggagtgtctgaagacagctacagtgtactcacacataagaaataaataaatctctaaggaaaaaaataagaagttgagctccttctgccatgtagatcctgatgattgaacttgaacttacattggcaggtttgtcagcaagtatctattccctgagccatctcacttgtcgctaaacttgtattctagtgggatgttattagaaaattacattttgtggtatgtcaaacatcaatcacttttaggaaggaggaggaggaggaggaggaggaggaggaggaggagaagaagaagaagaagaagaagaagaagaagaagaagaagaagaagaagaagaagaagaagaagaagagagatagatgacatgaactactagagagagatggtgcagttttaaatgttgtggtagctaagaacttcttttagaagtaacatatgtataaattacaaaagttgatggactatgtcatgaggaagactctatactaagagaacaagtgaaaagataatgcttgttttctattggagaaaggctttgtagttaaagagcaaatgaggtccaaatgttgaagggggagtgtactggctagttttgtgtcaacttgacacagctggggttatcacagagaaaggagcttcagttgaggaaatgcctccatgagatccaactctaaggcattttctcaattagtgatcaagggggaatggccccttgttggtgggaccatctctgggctggtagtcttgggttctataagagagcaggctgagcaagccaggggaggcaagccagtaaggaacatccctccatggcctctgcatcagctcctgcttcctgacctacctgcctgagttccagtcctggcttccttggtgatgaacagcagtatggaagtgtaagccgaataaaccctttcctccccaacttgtttcttggtcatgatgtttgtgcaggaatagaaaccctgactaagacaggggagtaagactttgtaaagattaggtttttccctaaatgaggtggaaacattgtagaactttgagtagatgaatgctatggtgaattgctttggacattgaatttaaaatagactttaaatttggcatgaaaggacatatctataagcaaccccagcatttggcaggtagagggaagaggatcagttttcagtgccatcatcaatgacatagcaagttcaaggtcaatctggactacatgagaacctgaccccaaaactaacaagtaaacaaatgacctaacagtataagcaggcaaagtagtattaagatgatcaatcaaatgtttcctgcagttttgtgagtggcagtagagatagattctttctatattttaaagttgtttctgagatgaaataaataagtaaataactagcaaaaagctaatggaaagttttgtgctagggagaagactaaggtcattcattacctttaggtaatgtacctataggtactttgcacattgatctcattaaatcttggcaatagctccacaaatgatttattattcctattttagagatgaaaagactgaggccgtgaaccattccttcacttactgtattccgaggcacactagtctatgtgatagttgaggtaatgtgtcaggacagaggaatatggaggaccttaacaattcctataacagggcatggtggctcatgtccatctcagcacttgaaaggctgaggtggaagattgctacaactttaaggccagcctgaactgcatagccagcctgggctacagagtaaggccccgtcaaaagaatggagaaggggttatgatagaaaggggaaagaggagaaggaagtcctgaggagaaaataacagacaccaacgaacccagcgttacacatgaggaggcagagggcttgagaaggcaagattttaaggggccaaacaacagaactatgattgaaaaacaggtctgttgactcttgtactggctaattttgtgtcaacttgacacagctggagttatcacagagaaaggagcttcagttgaggaaatgcctccatgagatccaactgtaaagcattttcacaattagtgatcaagggggaaaggccccttgtgggtgggaccatctctggactggtagtcttgggttctataagaaagcaggctgagcaagccaggggaggcaagccaataaagagcatccctccatggcctctgcatcagctcctgcttcctgacctgcttgagttccagtcctgacttctttggtgatgaacagcagtatgaatgtgtaagctgaataaaccctttcctccccaacttgcttcttggtcatgatgtttgtgcaggaatagaaaccctgactaagacaactctcatatcagaattcttttcactagaaaggcattattttggccaggcagtggaggcacacttgggaggcagaggcaggaggatttctgagttcgaggtcagcctggtctacaaagtgagttccaggacagccagggctatacagagaaaccctgtctcgaacccccccccaaaaaaaaggtattatttttacatatgcactcctgtgcctaaaccatctccacaagcagcaaattgtggaaatgaaaaaaaggttctaattttctctactttacaagactcagctgcaatactaactgcctccctaaagcctcaaggagtaatccttctctcagaaagttctcttccttttctttgagtcacattagagactcctgttcctaaatgactgtgtttggtctgcttcagaattattattattgttttttttttgttttgatttttcaagacagggtttctctgtatagccctggctgtcctggaactcactttgtagaccatgccgcttcaaagttatttgaactcttatctgactctttttgggatttgagcactttgagagaacatgggttgatgtgtataagtccagtcgaatggaacgcattctactcagcagttttggaaagaacctttggacggtgaaaggacctgtggattgtggattggaaaccgcagtgacccagtgacctagctacggagactagaagcaggaatggtaagtacagtgcccagagttagccagcattccacttcaggacactccaggctcctcctcctccctcccctcccctccccctccctctcctgtgtctttctctcccctactctgtgtgtgtaagttttgggaaagggacaaacacgaaatctagtttatttaaaagcaacttttgatttctttcttcacttggatactaaccagagaggcagctttgctgtagggagtgaagtttacagaagcatgggtggaatggagactcaaaccctgatgactcactgctgaggttaattttagggcttgaaggatatattaagtgtgaaattatggatggaccatgggtatcatgatggagtatggttaaaccttttagtgcttgggagaatctcatcacttgataaacattttctctttctttctttctttttttcttttttttttttttttgtttttttgagacagggtttctctgcctggttgtcctggaactcactttgtagaccaggctggcctcgaactcagaaatccgcctgcctctgcctcccgagtgctgggattaaaggcgtgcgccaccacgcctggctggcactccacttctttcagattcagttttcttctttctttactttcttttttaatttgcaaatttgaaaagttgtttttatgtaggcatttgttgggcagaacatgctgcaactcaaagcattgaaataaggactgtacctgcactattgacatattaggtacagatttggagcttcaccttcataacataaacttacctccatgtttgacttgcacctttgtgactgagtatccctcaggaagggattatcattctttttttgggggggggggttcgagacaggatttctctgtgtagccctggctgtcctggaactcactctgtagaccaggttggcctcgaacgcagaaatccgcctgcctctgcctctaaggtgctgggattaaagatgtgcgccaccatgcccagctagggattatcattcttttttttttttttttcttttttttcttttttttttttttttttttttttggtttttcgagacagggtttctcttttagctctggctgtcctggaactcactctgtagaccagactggcctcgaactcagaaatccgcctgcctctgcctcccgagtgctgggattaaaggcgtgtgccaccacacccggcgggattatcattcttattaagcattaaaaaaaaaagtgtaagtgtttcgatttatcctgggaacaagtccttgagttagtccatttccaaggctgattcttgggagcagctgagttagtgaggctgtgccttgtctcctttctccatgctgtgcatccctcctcactcttggcctcttgcttcttcgtggaactttggcaaaccaaatcctagggtttcttgggtacagctctctctttgcatttgtctttatgtttcaactctgacttactagggagccttatgaaaatcaaagttatctttcttcctttgcctagaaaaaagttttagacgttttgtccatcttcatcatgagagggagcatgacatgggaccatgtgggcagacacggtggggggagaaggaactgagaattctacatcttgatctacaggcagcagaaagagacaatcagcttcagttttcaatattttaaatgggaggcttcctctggcaactgatggcagcagatgctgagacctgcagccaaacattaggcagagagagagagagcctaaattggagacctccactgggtcaccctgggaaccctgaggaagagggggaggaagaattgtaggagccagaggggtagtcaaggatactggaagaacacagtccacagaatcaactacccaagctcataggggctcacagagactgaaccaacaaccagggagcttccatgggtctgtgctgggtcttctgcaaatatgttatggctattagcttggtatttttgtgggactcctaactgtgggagttaggcttgactcttctgtgtacttgtgggaccctttccctcctattggattgcctctcttagcccagatatgagtgtttgtgtattgtcttattgtaacttgttatgctgtgttcaggtgttatccctgggggagggctgctcttttctgaaaagagaaacagaggaggcttggatgtggggagaggaattggggagggaagggaaataaatggtgtctgggtgtagtgtttgagagaagaatagaaaaacatggtctctatagtgatgttgagcagattccaaggttgggcggattcactgcacctacagcttgctcaacattaaaatagctattatggctgccattcagtgagtggggagactacaaagcaaggctcatcatgaatggaatgcctgctaattgatgtgaaggttgagaacagtttggactctgcctgttgactctctgttcaagcttttgcgctgcaatctacctaccattttcattttgctccttgagcttcttggtgccttggtggtggtaccgctcaactgaacttcatcttctaacagtctttaccattctgatgaacatttgcacttcctggggagaatccttgagggaattagaaccactaagtgttggtcgaagcaagattaaggtatgttggttatttaatttgaaaaaaatcatcattttatttgtttacatttcaagtgatatcccccttcctggttacccctccacaactgccccatcccattcctcatctccccctttccctttgcctctttgtgggtgctcctccatccactcagccctttctttatttcttccctgacaaagttatcattgactacagagttgttcagtttcaatgtatatgtgggctttttgttgtttttgttgttcttgaaaaccagcctgactaaggtatgttttatagaaagattgaagtatcttgtggaaatgtagggaattaggacaagtacccattggaatggtcgaggaagagttctatagtaacggaggggccagattcccagttttggataatgagaataaaagaaaattgggaggtccaaagctaggagaaagacaaaagttaacatagcaaagaaataggtgtgctagacattcaagcacaatttaactctgggggcagaagttatgaggagacaagcaggagccactgcctaaagtcaaggtctcatgtgtatatgggaagggttttgcagaagagagagggtgaggcaagcagagatcagtccctactagggagacactgcatgactgtagcagagggatattaaatgacagcctgagaggctagaaatggttgactctaaaagaaaaagaaaaatgcatgtcctggctacttgctggaggaacagaatcagaagcccagttaatagagcatgtatgtattcctagtcagaacttaggcatttgttcctacaaatttctagcaggtgcatcaaaaatcaaaggcattgaattgttctcagccctattttacaggctactgggggaaaggagtaggactgcagactcagatctgctaactggcccaaggtaagagagagagagagagagagagagagagagagagagagagagagagagagagagagagagagagaggaagaggaaggaggaggaaggaaggaaggaaggaaggaaggaaggaaggaaggaaggaaggaaagaaggaaggaaggaaggaagaaatctagcacaaagctgctgttcgatcatcctttagtcttattacagtattcatgcctggcctggggattgggacttggaaaatataggttagatattatggccatatatgttgaagatagcatgagaaggaaaagttgcaagacaggaaagtccagttctgaagaagaacatgccaccacgcccagctaataagattatttgtttttctgtagtccaacttcttgagttctttatatatattggatattagtctgctatcggacttaggattggtaaagaccctttcccaatctgttagaggcctttttgacttattgacagtgtcctttgccttacagaagctttgcaattttatgaggtcccatttgtcaattcttgatcttacagcacaagccattgttgttctgtttaggaatttttcccctgtgcccatatcttcgaggcttttccccactttctcctcaataaatttcagtgtctctggttttatgtggaggtcttagaacacacaagatacaatttgcaaaacacaagaaaatcaagaagaaggaagaccaacatgtggatacttcattcctccttagaatagggaacaaaatacccatgaaaggagttacagagacaaagtttggagctaagacgaaaggatggactatcccgagactaccccacccagggatccatctgataaccagccaccaaacccagacactattgcatatgccagcaagattttgttgaagggaccctgatatagctgtctcatatgaggctatgccagtgctcggcaaatacagaagtggatgttcacagtcatctataggatggaacacagggcccccaatggaggagctagagaaagtacccaaggagctgaaggggtctgcaaccctataggtggaacaatatgaattaaccagtacccccagagctcatgtctctagctgcatatgtagcagaagatggcctagtcagccatcattgggaagagaggcccctaggtcttgcaaactttataccccagtacagggaaaacaccagggccaagaagtgggagtgagtgggtaggtgagcagggcaaggggagggcatagggaactttcaggatagcatttgaaatgtaaataaagaaaatatctaatgaaaaattaaaaaaaaaagagttcaaggcaaaaagagaaaaagaaaaagaatatcaaatgctttatgttttctagtatttgtacactaacagaagcaaactatctggcagaatgaaggagactagcaggaggggaaagaggaaagcggtagggaaggcaggggaacagtgggagactaaacccaagcatatcgcatgcatgtctgaagattcctttacagaaccaagttttatgtaacatagtgatctgccaaaaataaaagtgaaaacagaacaacaacaacaaaaagaataggatgaatctttcaactttcaagaactgtatctattgacatacttcatccagtaaggtcatacttctcaaacttcccaaacagagccatcaattgaggaccaagtttcaaatgtatgagaccatgggggacatttttttttcaaaccaccacacattatattttatattgtgatatgaacatgagatttggggggaagaaaaaaagttaggaaaggaagggaagtttatggtttaatcatgataaatctgtatgccacgttgataaaggatcaattttgcttgtttttagaaaattgacatatactgtagttatctgagaagagggaacttcaattaaagaattgccttcatcaccgggcagttgtggcacatgcctttaatcccagcactcgggaggcagaggcaggtggatttctgaattcaaggccagcctggtctacagagtgagttccaggacagccagggctatacagagaaaccctgtctcaaaaaaaccaaaacaaaaccaaaaaccaaaaaaaccaaccaaccccccccccaaagaattgccttaatcatattgaccagtaggcatggcttttgtatattttcttggttaatgattgacataggatggcctagcctactgtggctgtgtcattctggtcagatagtcctgggttgcataataaactaatagtgctactccctggactaagcatattcaaaccacttctgagtttgaagcaagtctgtcctacggagtgagctccagcacagccagggctacacagagaaaccctgtcttgaaaagcaagaaaaaatataaaaagattggcatgtaaacaattctgtgtgacattttcataatagagaattgatgtggaatcaacaggccactgtgggtggtgccattcctaggtcctagggtgcaaaaaaaagtgaactgaagaatccaggaggagcaagccagtaaacatggctatactggctagttttgtgtcaacttgacacaggctggagttttcacagagaaaggagcttcagttgaggaaatgcctccatgagatttaactgtaaggcattttctcaattagtgattaagggggaaaggccccttgtgggtgggaccatctctgggctggtagtcttggttctataagagagcaggctgagcaagccagaggaagcaagccagtaaggaacattactcagtggcctctgctcagctcctgattcctgacctgcttgagttccagtcctgacttcctttggtgatgaacagcaatgtggaagagtaagctgaataaaccctttcctccccaacttgcttcttggtcatgatgtttgtgcaggaatagaaaccttgactaagaaaatgggtttgcttcagttcctcctgccttgacttcttaccctgaccttcgctcagtgatgaactgtggatgggatgtgcaagccaaataaactcctacctccccaagttgcttttagttaagatgttttattacagcaatagaagcatagccaagacacctacagaataatggatttctgtacagcttcttcatacatcattagttttggttaactcacctctttccccatattcttccccatttccctacctactttttattttgttttgagacagagtttctctgtgtagccctggctgtcctggaatgctctctgtagaccaggctggacttgaactcacagagatctgcctacttctgctccttcatcccatgaatgctgggattaattgcatgagtcacctcctccaccaccacctggcccctattgatgcttttaacccagagtattcctccctattttttcctgtcatttgtgtactatatcacctctgatttacacacacacacacacacacacacacacacacacacacacacacaccacaccacaccacatacagacacacacagacttgggttacaagaatgataggttccatatagctttttcatctacctttcatgattaaatttttccccatcccttgtttgcccatcacaactcctttcatgcttgaatctttctgcatccagtattcactctctctatctttattttgccatattttattatcttccttccctaaatatacccaacctcagaatcccatttctaattgcctgacttctgcatacattccaagttaaacaatacaaaacaaaagagttaatgttatgatccacatcgaagagaacatgtggcatttgtctttgtgaacctggctgacctctctgagtataattttttctagttctacccatttgcctgcaactttcatgctttcatttttccctcatagcaaggcaacattccattctccctctctctcccccctctctctgtatgtatgtatatcacatttttcttacccattcatatactgatgaatatttaggttgttttagtaatctctgaacgattgtgaatagagcagtaatcactgtggatgtgcaagtatctctgtagtaggatataacgttctttggtatacactctgaagtagcatacctgggtcacttagttgatctatttctggctcttttttttattacatattttcctcaattacatttccaatgctatcccaaaagtcccccataccctcccccctatttctggctcttaaagcagcctccagactgatttccatagcggctgtactcaaatactaggtatccccttattaaaagtgtaaaggtgtctcctcacatccaggccagcatttgttgtcatttctatctcgggttacctctactctgactgcaataagatggagtgttattgtgacttaaattagccttaccctgttaatctgtggttattatccatttgtatttcttgttttgagagcttttagtttagtttcatagcctgctttttaaaattgggttgtttcttctcatgatttgtagattcccccctaatggattgctaggtggcaaaggtttcctcccattctgtgggttgtctcttcatttgattgacaatttcctttgctgtatagaagcctttaaatgtcatgagttactctttgtcaattgttagactttgttaacaatgagagtcctgttcaggaagtccttgattacacctctaagttgaaataatttacgtaatttttgttctagtagttttgtagaatcagataatattgaagtccttggtctactgggagttgagttttgtgtagtatgaatgacaaacatctagtttcttttttcttcatgttgagacctagaattcctaaaactatttgttaaagagatgtcttctataatgtgtattttttttttggtactttgtcaaagaccatgttgctataactgggcagactttgtatttgagtgttctattccattgatctataagttcctgtctgtctgcaccatgatgtttttattattattattattgtggctctaacatataattagaaatcaaagtgatacctctggaagtactgtttttattgaaggttgctttgaacatctcacagctgccttagcagaagctgcagacccagagcagagacaggattgaactctagattagtttcacaagcaagtgtgaagttccacatctcttgcttcacagaaactgcagacacatgatagggatgggatctgactcagaggaaagcccacagataaatggggtgttccacaactcagtgaaagctgcaggcccagccaggaggctcacacctacacagaggaagataagaggtagtttctaaccctaaataccaaccccgaagaggggcaatacctcaacccctagtataatttagtcttccccctgaacgttgcagaaaccatcactaatagaaaaaaaaaagagggctggaatttaaaagaacatatacagaattaagaaaggaaggaagaaaaaaaaacaacatgaaaaaacaagatagcgtgtttttcaaaaaatcactagtcctatagtaatggctcttaatggtgacaatctggaaaaaaactttcagaaaaagcatttaaaagaataattgaagtagtctgaaaaatttaaagaatgcataaatggagtccaagagaacagaaacagagcggagtgaaataaagaaataaatccaagatagaaaacttgaattcagtaaaagaaattgttgaaggaaaaacaaactcaaatgatggctagaaataaaaactcaataagccaaataaaatgctcagtggaaagccttaccaacagaatgggttgtgtggaaaacagggcttgaatataaagtaggggaactagatcatttactaaagattgacgaggaggggctggagagttggctcagtgggtaagagcactgactgctcttccagaggtcctgagttcaaatcccaacaatcacatggtggcttacagccatctgtaattgccctcttctgctgtgtctgaagacagtgacagtgtactcacatacataaaataaataaatctttttttaaaaaaatcaatgaggaattataaaaatatgaatagaacacatgaaagctctggaacaccatgaaaagacagatctttgaattatggtcatagaaagaaaatctctgcaccaaaggcatagataaaaatttcaataaaatcacagaagaaaatttcccaaatgtagagaaagaggtgctcagacaagttaaaaagaagcccacagatgagtaaatagataggaccagaaaaggaacttcccatgacatgttatagtaaaaacacagacagaagaaaatattgaaaagtgaaaaagggaagggtcaaataacttataaaggtagtccatcaatcagaatgacactcgattagtcagcagaaacgttgaaagccagaaggacctggaaagatgtatacaaagatctgaaagccaacaactgccaaaccagactattatacttaggaaaactgtgtgctgaaattgaaggataaataaaaattgcccatgataaaaatagactaaagtaatttatgcttactaagccaactgtgcagaggatactggacagaatatgtcaatctatagggaaggataaccacaagaagatgccacaggaagaagtaaacaaaccaggacaattgaaagaggtttaagaaaaccccacaaaaccaacagaatgccaggaatcaaggcaaaactgtcaatagtaactctttttgttgttgttgttgtttttgttttttgttttgttttccgagacagagtttctctgtgtagccatggctgtcctggaacccactctgtaaatcaggctggccttgaactcagaaatctgccggcctctgcctccaaggtgctgggattaaaggcatgcgccaccactgcctggcagtaactcttaatattaatggtctcatttctccaaatataaagatatggacaagaagattgaatcaaaaaaccaggatccatcaggttgggtggacatggtgcatgtctttaattgggaggaagaggcacgtggatctctgagttcaaggccagcctgctctacacaacaatttgaagggctacatggaaacaccctttctcaaaaaacaaccaaccaagcaagcaaacaaaaaaacaacccaggatctatctttttgatacctctaagaaacacatcacagcatcaactattgacaccactataacttcaaagaattgaaaaagatacaatgtaagcaaatatgcttggtattgtaattctggttaaaatcatatgcctgaggaggtcataggccctaaaggagaatctcttattggtctttttgctaaattgtcatgcttctaaatatttctgtttatacccatagacctggtttgattttaaggttggccaaagaagctttttttttttttttttttttgatttggccaattaaatggatggtcccatatacatgtacttgtggtcagcaacaactggacttagtaggttataaaaggcacagacatgttgaagaggatattggtgaaattggaaggggaagtagaggtagatatgattaaaccacagggttcatgcatgttaagcaagcatactaccaattgagttatagccacaactcttgatttatatttgttaggcttaaggtacaaaggtgagtttccttgtctccaaccactccccctctctgcccccaagaaagaaaaaaaaaagaaagagagagaaaggaagggagggagggagggaggggaggggaggggaggggaggaaaggaaagaaaggagaaaaggcacttgggaggcagagtcagacagatttctgagttcgaggccagcctggtctacagagtgagttccaggacagccagggctacacagagaaaccctgtcttgaaaaaccaaaccaaaccaaaaccaaaaacaacaacaacaacaaaaacaaacaaacaaaaaagaattaatgaaagaaagaagaaacaaaggaacaagtagcaaagtatgctgatatggatgtagctaatggggacactcacacactgctggaaaagaaagatgagttgggtgtttgaggaatgttgtggagatgggttggggggccactagtaacatttatgtttgttttttttttttgtttttttttttagtttttatttccccaaaacatagtatgtgtgtatgtgtgtgtatggggaagggcactactagcatttatgaagctgtggatgtgagaaccataatttttattccccccccccatcgctatgtctcactagctgtcctggaacacactctgtagaccaggctggctttgagcccaggagatctgcctgcttctgccttccaagtacttagatgtacttagatgagccatcaccactcagcaagagctagaaatattagttaagctcacagggtctagcctccttgaaagaagagataactgagaaaaggagaaaatgacttgccttgtggtgtgaaatgaattagtaacaggagtaaacccccagatctccatcttagattccaagatcttcctgccttttcttcatattatcatccttcacagtaggctacctctggccttgctctgagaccccatctggaggtaggatgaatgaaatgcaaaatactttgtgaattttgagattcgtgggtcttatgtaggaatgcaaagcaaacagtgcaaactctgagagagactgtgctgatttggtttttctcaactcgacacaatttaagagtgatctgggaagagagaacctcaatccagacaaatgtctccatcagattggtctgtaagcaaatctgatcgtgcattttcttacttaatgactgatatcggagtgtccattgtggatcatgccacccctgagcacgatgtggccctgggtaatttaaaaagcaaactgggtaagtaatggtaaagaagtgagtgagcagaactccttcctcatggcctctgattcagttccttccttgagttcctgccctgactcttcatgatggactgtatgctatacagttaaaacaaatcctctctaagttgcttttggtcatatttgtttatcacagcaatagaaaaactagagcagatactctgaaagctctaatgtagttctggatgctattaaatttgttttctgatgctaatacattagcctccaagtcacacgatgaacagcagcttctagtgttcttatagaaatactgacatgtgaagttacagaagtgcttatgcctctgcttcaaaaccttacagtttcctgcttgtcttgttatgggaactgaacacttgatgactggaaagtctatgtaacacactggtcacccattgaatcagctttctggatgagtggattgagtatagcagacctaggataaatcaaaacatgcgcttaccttgtctcttttccagagagaatctatatcaactagcaagtatgactgttttaattttattgcattcaattaattaatcaatcagtcagttctctcctaccacatggatcaaactcaggtcatcaggtttggtaaccgttacctttactgccggaactacgtcaccagctcctgtgcatggttttgaaaggagcgaggagctgcttctccacctgcagctgaacttgtgagctatggctggctattgcccaaatattcaggggaagcatatttttacatttttgaacaataattgtcctcctattggggatttattcaagttaatgaagagaatttgttttaaggtgggacaaatgtgtcatagtatttagctacatcttccataaagtcaagttgctatatatttatcatttgttggtcagaaaagcagattatctgatgtgtacgtagaattcttagtagactgtagaggattcctaagacatcttcaaatgagacctttcctttgcttttgtgactctctggcttctcagaaaggtacgtgattattttgaaatggtagttttaagcttatctactgcgtgcatcttccatgccagaccctgataccaacttcctaaacattgtctgtgtaattcctattatttaggcactaatattttctacttgggatgtcttttcccctttcacttactgaaagcccatacattcattaataacatctcacatataaaagttacctattaattgattacgtagccaaaagaaaatattcccataaagtcccaaggatcaaaatgtccggcctggttattcttgaacacagtccatgtagtcattgtactttttaaaatgttttacatattttatcctgccatcatcttttaaaaactaaaaatgcacaaatttgcatttatcagtgctcatctctttaaatattttttcacttctatcccccaggctgtggtttccatagtatccatttttcatgagagtataagagtgttgttctcaccagacactggctgggctgactcaccattagctgcataatttctcccaggacttttgtaacagacacaatacacatatacaggacttcttttgtttatttttttccttttttcttttaaaaataagcatatttccagcttctcacattttctttgaatatactgcacattattaagaaggtattacatctcagggaaaaatgttgttttgtttcgtttgtctccactcaggaagtgctaactgtgggtgccttgcccacagtattcttttctaaaataagtattattttctaaaagagataattgcttgttgtctgtgtggctatcatcaaagaggactgaatagatgagcttgtaggatccaagtctgaaatgacaacaaatttctactgtaaaatttccagtttttatgtaacatacccattgttgaaaagattcttccaaatattaccagaaaggcttctcagcgactgtctgtatgagaaaaactgagatagtgttcatctcaaagatgggagaagaaaactactaaccaaaatcatcacgaccaagtcaatgaaagcaagcaattcatttaagtttttaaattcatgcacacaggttgcctctctgttattcgacgcgttctcacgaccggccaggaagaacacaacaaccagaatcttctacggcaaagctttattgcttatatctttatcgggccagagtgtaagaagcaagagagggaagcaagagagcgagaaaaacgaaaccccttctattttaaagagaacaaccattgcctagggcgcatcactccctgattggctgcagcccatggccgagctgacgttcacgggaaaaacagagtacaagtagtcgtaaatacccttggctcatgcgcagattatttgtttaccaacttagaacacaggatgtcagcgccatcttgtgacggcgaatgtgggggcggcttcccacagttccccctttttcttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatgtgccgcagagcccttctactgcagtgcttagccttgcaactctctcgggctgctgaagcacactcactctatctcgtgcaatgagactagcctcgtgagatataagagctgagtggccagcgacctattgcttaagcatagatatatcaggggaagctccatgttctagtcctgcaagcgcctgggcaataaccaccttgtctctcttagtttgggccttaagcttacagaccaatcaaagaagcaacactaatccacagcaacgtgtatctccaaataatattaatcccacccaattttttaaagaaagaaaatgctgaggagatccaattgggtaatcctttggtcagcgacaggtccaagcgcgtggagttgacctgaagtctcaattctcgaaggatctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtatcttgacattagctgaggcctgtttatctatgactgtagtcactgaggctgacaaagtgttaatggtgtcagtcatctggacctgtccagacagaaccaaggctgtctgaattaaggccaaacccagttcccagttagtggtaaaaaagcaggagaatacttgagcattatacatcaccgtcattgggagtggaaatgtcgacattatcccccaacgctgctctctctttattattgacgccctggacatcaccaagacgagggacattagtattcccttggtcagtctggatttttcgggtgagtctttctggtacccaaaatgggttgtcttcattctgtgggaaaacacagatagctcccctggatcttatcaagataggatccgggccataccatttattatcaaggacatttttccatttaaccatctcattgggcctatctggctctgaacaatgacgttcagccgcagtatggccatgagcatcaatatttaaaaaattgagtgtaaagagtgccaaagacaccgacactcttggtgctcggggtacagtctcctcaaaagttcccctcttctgttttataagataggctttgagggtgcgatgcgcacgctcaacaataccctgtccttgagggttgtatggaagtccagtcaggtgggttacgtccatctgacggcagaactgctgaaatttttgggacgtataagctggtccattatcagtcttaaggagtctgggtttcccccaagcactccatgcctcaagacaatgttgaatcacatgtgaggctttttctccagttaacggagaagcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattgagtaacaatgtcacgggcttcttttcttgtcaaggagaaacgactgcgtaatgtttcagccgtcacatgaaaattattatgaaaatttcttgcagcctctaccggggatgatagggcagcagccaccactttagtggccttatctgccaaatcatttcccagagccatggggccaggtaggcctgaatgggctctaacatgagtaatataaacaggagatcttctagataacaaaactaattgtatctgctgaaaaatattggcaactctactggaaggcttaatcactccagccacttctaaaagatttactgcatttaccacataacaggaatctgacacaatattaaggggttctaaaaaggtttttaaaacttctaagaccactaaacattctaccacttgaggtgaattttcattatattgtttggataccactttaccattagccacataggcacctatgccagtttttgatccatcagtatataccacaatcccatttttaagtgggtttcttactgttatttgtggaaacacaacagattgattttgggcaaactgtaagattggatgctttggataatggttatctatttttcctgaaaaggaggtaactaaaactgcccaatcattagatgcggctgccaaggtttgaacctgtgcagcggtataaggtacaattaaaagatatggactttgcccaaagtgggtgattgctgcttttaggcctttaagggcaagctgtgcaattgcatcaggataccaatctattattttagctggggatacgtttggatggatccacaacaatggcccattttgccacaaaactgcagttggcaattgtgctgtcttaaagacacacaaactgaaaggctgcgaatcctcaatacgttgtaattgtgcattctgtaaggctttttccactttttgtaaggcctggttagcagctagagtaagagtcctaggggaggagatatgaggatctccttctaaaatactaaacaaaggccttaattcagcagaaggaatctttaaaaagggtctgagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtagaccccactgacttaaagttttaagtagaaaaggatatgccttttgtagcatggtaaggtctttatggcacaggaggatgtcatccatgtaaaggagcaaaattaaagaggggaattgttccctcactggcaaaagagcttcttgtacataaagttgacacatagtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataatgattaaattccagccacgtggtaaggcggaaagtacagggagacccctctgtactgggccaaataagttcatttgctcattaatggctctgaggtcatggagcagtctccactttcctgactttttcttaattacaaaaattggagtattccaaggtgaggtagagggttcaatatggcctaattttaattgttcctctaccagttgaatcacagcttctagtttttcagaggataggtgccattgaggaacccacactgggtcccctgttttccatggtatgggtcgtgctgccccaatggccgctatggaaaacccagaccctgtctgtcttggtttccattaggtgagatgggctctatccttccctgttcttgatgtcctaacccttttccttctttataacccatctttgccatgatattttttgctttagctgaataccctcctgatggggcgttttcattggacaaaataaggcccaaatgctgcataatatcccttccccagaggttaaccgggagtgggagcacataaggtatgaatttcccttgctgcccttcagaggattcccacgtcaaggcaacggagcttatagtgggacatgattgatatcctaggccctgtaatgaatgagatgactctgtggtgggccatgctttgggccaccaatgtgtagaaattatacttttatctgctccggtatcaaggatgccttcaaactcttttccattaatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttagggcttgagcacaggacctgtatttcaggggaatgttgacaatccataattccagggtggactactaagccctgcaaggtgagtgaacctcggccgagaataaggcccatggttcccgggggcaaggatggtataggctccaccggcaccggctgaatactcatttgaggcattaataggaagtcggaggcggcacgcaggtccacccttgtgggtcttcctgggtcgtctctctgactgcttcctgggtcctgacaaaccggttcccatatctttgagggccctgggaccgagggcccggtgacccgttttttggcacatcagctgattgactatcaggtgggggaagaattctgccctttatatccctcacagagcgacactggtcagctctatgataacccttgccacacttagagcaaagagtgagagtccctccctgtttatctggagctctgcaatctttcttaaaatgcccaggctttccgcagttaaaacatgtcctctgatcatttctgcccatggagcggttttgggattgaaggatggcagccgctaaacctgcattgctaaggggtcccccaagctctcgacagaccctgagccagtcttgtaagcctttgttctttcttggggctatggccgctcggcactcctttgtggcttgctcgtagattagctgttctatgagaggcgcagcttgctctgactctccaaaaatacgctctgctgcctctgtcattctggccacaaaatctgagaaagattcctgaggtccctggattatttttgttaactgaccagtggtttcacctgctcgagagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcctgtgcagcttcgtgccaaagcgctttccattccatatatttgcccatactaggaagagcggcttttacaaccgtctgccaatcagcaggcgttagtgccataccagcgagcctgtctaactgcaccaaggtgaaattagcattggttccgtatttacgaaccgactcggcaatttccttaatctgtacgtattctaccggagcgtggacacgcccaccctcggctccttcaaagactggaaatgcctgttctattttcttttgttcctctcggggaatgaatgagtctgcgcactgcctctctgcgcactgcctctctgcgcacctgtctgcgcactgcctctctgcgcacctctctgcgcattgcctctctgcgcattgctgacgcactacgcagggcgggggctccgcatagggcggaccttgaaaccgactgccgggaggttgaacagtacgctgactttcgccagccgcttttggcttttttcttgaccaattagctggctggtaatgggctgcttcttcctcccagtctgtttcctcagaggaggattcttcacttgcttcagagctactaagagctggcttcctgagctcatctagtgacgagtatctcctagagacctccgctaatcgatcttttttcttttccctttttcctctttttcttctaatctctctccaggtattcctacctaaccttaacttttcctcgggttcaagacccttggaaaggcctgtatacttaccgtttctccttgctcctactctctctccccgctttacttctgatagactgccctgaatttcatccagaattttcagccctgccttaaccactatataacatgtgaaaaggaacaaaagggctcctaacaccagaaaaaattcaaggccaaacatactcactggtactctcgttccccagctgaaaagttctgaattcatacagttgaatccttcttaacagtctgctttacgggaacctttatcaccgtcgttccccagctgatgagttctgaattcggcagttgaatccttctcaacagtctgtgttacgggaacctttataaacgtgatccgtagttctggttctgaaatgaagtatccctcctgcgccagtccggagttttttctcgtcccggattttctcgtcccggaattcggcaccaattgttattcgacgcgttctcacgaccggccaggaagaacacaacaaccagaatcttctacggcaaagctttattgcttatatctttatcgggccagagtgtaagaagcaagagagggaagcaagagagcgagaaaaacgaaaccccttctattttaaagagaacaaccattgcctagggcgcatcactccctgattggctgcagcccatggccgagctgacgttcacgggaaaaacagagtacaagtagtcgtaaatacccttggctcatgcgcagattatttgtttaccaacttagaacacaggatgtcagcgccatcttgtgacggcgaatgtgggggcggcttcccacacctctcccctaaggaggggttgaagaggtcagcattggatgtgtatggttagaggtgggtgtatatagctcaatccgtgagaaacaaaggtttaattataaacaggagcagatgttggctttactataagatggcttttaagccaaaatggaagcaggttggctcttcagtagtattttataaatatttcggaggactcaatggctgcctgtagcatacttcttcactttccctcagagagaattgatggatgtctgctgaaatcttgtacatttgtaggtttgttggcacaattgctgtaaactattgcaccatctgctgtgatctatagctctattctgtgagaaagatctattctgtgagaaaagttgtacgaatcatggttgacaagtgccacccaatgtgcatgtccttgaggaagtgggcttgccttgcccacagttctgggagaattcctgctgctttaccggtgtacagatgaccatggattctgcacgcatctggagagagtgatgagtcaacttccctcggtgggagtgcataatgactcttgaaaacaatgttcttctgctatgtactgtgagtcagctaccacttcctctgtcacactctcccctgtgctgaaaagtcaaacactgatggactatgaccatctgcaaacacaaccattttctctgctaaatccagtgatctgctccaaaatactcatacttcatggtgacaattattgctatgctgattctcaacttgctagaaaagtccttgtctacttcacattcatacttcagtcattcatcttgatatgctgacaattctttatacccatggttttacttcatgaaattatacctttacttttaaaattatttttttattttttcaaaataaaatataatgacatcattttccctcttccgttccctccttccacttcttcccatgtaaccctttgttctcttaaattcatagcttctttttaaaatttttgtgttttataacataatataaatatataaactcaatcttctcactatatataatattatatatggtttcaggacgaaccacttgatattggataaccaattggggctcttccatggagaagacaatgtctcctgctctcagcatttcttagctgcctatagacctttgccatcctttttcaggtcttatttaagtaattgtgctgatgaagcttcatgggtgttgcttcttgacatttctaagaaacacagttgcacagcaaccttcttgtttctgtgattcttacatcctttctcctcacccccttttgctaagatctctaagccttaggcacaagaattgtgttgtggataggttggttggggctgagcattagacaatcacttgttctctgaagtttgattaattgtggttttctgtaatggtctcctgttgcaaagagatattttcttgattaggggtgagatctatacttgtctgtggatatatggttaaatatttataaagtagttaagaattatgctggtgccgggcatggtggcgcacgcctttaatcccagcacttgggaggcagaggcaggcggatttctgagttcgaggccagcctggtctacaaagtgagtgccaggacagccagggctacacagagaaaccctgtctcgaaaaaataaataaataaataaataaataaataaataaataaaagaattatgctggtttagaaaagtactggttgtagattctccaagatcaatgacttcattagccccagatagttggtttggttttcaatgctagtcaagatttcccttttgctgagcaggtcttaagtccaaatagagagctgttggttaccaccaaggtatgtgtgctgctattgcacccttagggttattgtgtcatgttggtcattgtagttcagagacagtatagctaggtaggactgctgattgctttcttcccttggaagtttgcatgacaccaactagtaccataaatgcctcagggaggaggttttcaggtcacatccagttctgatcttctatgtcttatgtctgaagtatgtggtagcttcagcaatatggactcacctttgatccctgggaggaaatcaagggcaaccataatagcttataatattttggacaactcttaccaacaactaaaatggaggcttcttatgcttgttgttggttttgtttgttaggtagtctatggctctttggtggaccattgttagtatggatgggaaaataaacaatatataaatgtgtatatatatatatatatatatatatatatatatatatatatacatacattatatatatgtattatctgtaattttaagtaactagataataatgattctcaatgactttttcatacattttaataattctagttattttaccctcctccctcctccttctgtaactttaatttttttttaactttaattttttcaagtcctattttttttttttgttttttgttttggtttttcgagacagggtttctctgtgtagccctggctgtcctggcactcactttgtagaccaggctggcctcgaactcagaaatccgcctgcctctgcctcccgagtgctgggattaaaggcgtgcaccaccacgcccggctttcaagtcctatttttaatgatgggttttaaccatctcttgaagcccaccactcaccagaagtagtggaaaagaaaggatatggagaaagtagacctgtttagaaaagttctttggagcaaccccactctatgttgtctggaaatgtacagttcaggtcacaggtttgcagcagcagctcaatccactcccaaacacctcactgatataccagtagagatattcagtagagtcgggatagcacccaagaatcagcagtagtggcacaacctagcagacagccaggcctcagcctctgctcgagtcagtagggacctggagggacaccaagagaagttcttggctgtgcctctctcagggaagtgaagatcagggaagatttgagacccacaagcattcacataagcttcttcacatctttgtcccagcaaaacactgtccaaccgactttccaaagacccttaagcttcatttcatccttctatatttatcattctccctttccttaattaaagccccctcattttccccaaataaattgtatactgctattttcctctattgctcccctgacatgaccccctttttcctttcctccctgatctggagattgaggagagtttgtggagggaagaatctgttggactcaccaggtcagaccctggtgcaagatatgcagaacctggcttgacagattgtgtgtggcacacgagggacctttaggtgggggtcacaacaatcaggggtggccagactaatcagggcactgatgtaggatcacagctaaacctaggtgtatgattgaggaggctgtgtggatgggaggaagggtaagggagacacacctggctagaccctggcacaaatgcacaggggtctagctggatggacagataaaatatgatgtacaagttgccatagattggagagagttgggttcaaatgtgtgtgtgtgtgtgtgtgcatatgtttatataatacatatatattatatatatgtttgctacatatatatggtatatatactgtgtgtagagtatttttagatctcttcattgtttaccatatatatggtatatatggcatatatataccacatatggaatctatataatacatatatatactaaatatataataaaccatatatggtaaacaatcagaagatctgaaattattttacaataaggtatttacctagtgaggagacattcagacatatctactggcatagattgaaccacttcaagccaaaagaagtataggttttgtcgattggtatctcaagtattttgcattttgttataaagaacattgatttcccttgcttattgaagataacatacttgtttccttgcaattcagtaggtggccattataggtgactcactcgatttcagctcttgttttgtttttctttttctttcatgagtcatctttctcctcaagctagaatatactttaatgtccttggtaaatagacccttctgttccttggagactctgttcctttattgcttaaaacgaaaacaaacaatttgtatggaatgataaactgactaatgaatgaagcaaaaatgtctcataatgaaattctatttacatcttgcaaagtaacaaagtgcccctgtttatagttatttccacaattgtaattagtgtcttttcaaaaattagactcacattagaagcttcattttgccattcatttgccaagtatttattgattgctctttaacgatctctctattagactcgagagataagaagacagaacccatgctttcaaggagtcacaggtccaatgtgaaaggcaattatttatagttaattacaaatacagaaaaatatttgtaattaatgccataatggctgtgattgctgggtgtatggtgctgtgaaagtaacagggacaaaggagctaactttggctatggacaaagtacaggagcagtaagtgggtgactgtgtgatagggaaaatgaaggaatggatggagaaatagtaaaaggtgggggatgctttgccaaacatatgacatccatacgaaatgtcagacagagaaattgagaaaggaaatccctggtagagaagtcatgtgaaaggctgggcagtggtggcgcatgcctttaatcccagcacttaggaggcagaggcaggtggatttctgagttccaggccagcctggtctgcagagtgagttccagtaggaactatacagagaaacctggtttcaaaaacaacaacagaagaggaagaggaaggggaaggggaaggggaaggggaaggggaaggggaaggggaaggggaaggggaaggggaaggggaaggggaaggggaaggggaaggggaaggggaaggggaagacgtcaagtgaaaagatacacatcatggttcattgttgaactcagtgactgctttgagctcatagacaacatgctatttatttatttatttatttattatttatatgagtacactgcagctgtcttccaacacacactagaagagtgaatcagatcccactacagatggttgtgagccaccatgtggttgctgggaattgagctcaggatctctggaagagtaatcagtgctcttaaccactgagccatctctccaacccccgagaacaacacgtttaatcatactcctcttccaccatttccttcccctcacttcataaagattgttgagctacagtatggaaataaaaacttggggtaggagtggttgtgtatgcctgaaatcccagcatatgagtggcttaggcagaagtatcttgagttcgaggcatgcctaggctataaagtgagaccttagagggaaggggagagaaaaatggagaaggagagggagagatacatacatacatacatacatacatacatatgtatacagacaaacaggtagatggagaggtgttcatatttaagattaaatttcatagctggaagccaggaggttgtggagaatactagcactagcatcctagcacttgcgaggcaaagtctgtcatatctcttgagttcatggccagtctgatctacaaagtgaattccaggtagccaatgaaggctacacagagaaactctgactcaaaataccaaaaatgaacaaacaaataattacaaagttcaaagctggaaagatggctcaatgtttaagagcacttgatgctctgtttttaaaaagatttgttaaacttttttttttaaacagtccagactttatccctctcctggtctgccctctgactgttccacatttcactcctcctccatcaccccggtctccaagaggatgctcccatcctcacccccaccccaccagacctccccactccctggggcctccagtctcttgagggttaggtggctcttctctgactcaggccagaccctgcaattctctgctgtatatgagttgggggcctcatatcagctggtgtatgctgtctggttagtggctcagtgtctgagagatcctggggaccaggttagttgagactgctggtcttcctatagggtcaccttcctcctcagcttcttctagcctttccctaattcaaccacaggggtccctgacttctgtccattgtttgggtgtaagtatctgcctatgtctcagtcagctgctggttgggcctctctgagggctaggctcctgtttataaagtacaccatagcctcagtgtactggctagttttgtgtcaacttgacacagctggagttatcacagagaaaggagattcagttgaggaaatgagatccagctgtaaggcattttctcaattagcgatcaaggggaaaaggctccttgtgggtgggaccatctccgggctggtagtcttgggttctataaagtaggctgagcaagccaggggaagaaagccagtaaaaacatccctccatggcctctggatcagctcctgctccctgacctgcttgagttccagtcctgacttcctttggtgatgaacagcagtgtggaagtgtaagccgaataaaccctttcctccccaacttgcttcttggtcatgctgtttgtgcaggaatagaaaccctgactaagacactcagtaatagtgtcaggccttggggcctccctttgagctggatcccactttgggcctgtcactggtcctcctttccctcagtctcgtctccatttttgtccctgtagttctttcagacaggaacaattctgagtcagagtttttgactgtgggatggcaacaccatccctccacttgatgctctgtctttctactggaggtgggctctataaattccctctccccactgtagggtatttcatctaaggtccctccctttgagtcctgagagtctctcacctcccaggtctctagtacagtctagagggtcccccacctcctaccttcccaggttgcctgtttcaattctttctgttggtcctcagggcttcactcctgttctccccttccctcccccaacccctgccaataccctacagaagaatggatatagaaaatgtggttcatttacacaatggaatattactcagctattttttaattggatattttatttatttacatttcaaatgttattccctttccaggtttcccctctgcaaaccccctagctcatctccccttaccccttctatgagggtgctcctccacccacccacccactcccacctcactgccctagcattcctcaacactggggaacatcaaacctttacaggaccaagggcctcccctcccattgatgccagataaggctccttcagctccttcagtccttcccctaacttctacattggggtccccatgcttagtccaatgaatgattggctgcaagcatccgcatctgtatttgccaggtactggcagagcctctcaggagacagctatatcagactcctgtcaccaagcacttcttggcatccataatagtgtctgggcttggtgtttgtgtgtgagatgaatccccaggtagggcagtctctggatgacccttccttcagtctctgttcaaatctttgtccctgcatttcctttagacaggagcaattctgggttaacattttggagatgggtgggtggccccatccctcaaccagggggcatgcttaacctctggatatggtcttgtcagggacaggttctccctcccccttgttgggtatttcagctaatgtcatccccgtgctaatgtcaattagcagtcagccccattgctacacacctctgttcaatttcctaacatctcttccatctcctgacatctcctccatctcctcccatacctgattctgccccactatttagctattaaagaggacatcatgagttttgtagacaaatggatggaactagaaaatatcatcctgagtgaggtaactcagaccaaaaatgacacacatggtatccactcaccaacaagtgaatattagcttttgcaaatagcagattttgtttgtttttaaattttatcttatttatttatacttatgtgtatgtacatgctgtggtatgtatattgaggtcagaggacagctttgtggaatatttttctcttcttccagttttccatgggttctaaatatctaacatagatattagtgttgtggatagccctggggctaattatatttgatttcaattccattttcctgtgaggggttgtgaacaaggaatgagtcagcactcagatgatttcttgtaaacctttttcccaccttaaattttaaaatagagaagaaatgatgattgggaagataaaggggaaggtggagtggaaagaaataaaagaaggaggtttgagagagagagaactcagagaaggaggaagaagaaaagtggagcagaagcacatggcctggagaatctgcaagttggttgtttcatattgttgttcctcctatggagctggaaaacccttcagctccttgagtcctttctctagctcatccactggagacctgctctggggaatcaagcctcaacaggcatgagggtctcctcttccattgattccagacaaggccatcctctgctacatatgcggctgaagccatgggtccctccacatggactctttggttggtggtccagaccctgggagctctgtggtgtctgaggtctggccggttgatactattgctcctaccatggggctgcaaaccccctcagaaggaactgctcttttaaggaagactgaccatccctcccctagaagccatcaactattcattcatagctcctcaggtagtggtgagggcttgtgaaaattgcctttatatactagaatgttgactggcttcaccttgagcagacagtcatagctatctgtgagttcatgattgcaacagttctgtcatgttcagaagacattatttctcttggtcctccccaatttctgtcttttaaaaattatgttttgcttatattatttgtgtgtgagtaatatgtggccagatttcctccttcttgaaggctaaatactatttcattgtgatatgtgtatgtatgatattgttatatacttacacatatgtacacataaacacattaactttcagactacttttgttctttaacaatttcatacagccagggatatacagagaaaccctgtctcgaaaaaccaaaaaccaaaaccaaaaacaaaaacaaaaaaacccaaaaaaacaatttcatacatgcatattctgtgtcttgatctgatcaaattctaagtccccccatgactcctcctaggcaccctccaacaattacccctcctaccttaatgtgctctcctttaaaattattattattattattattattattattgtcattattatttttgtttttcgagacagggtttctttgtatagccctggctgtcctggaactcactttgtataccaggctggcctcgaactcagaaattcacctgcctctgcctcctgagtgctgggattaaaggcgtgtgccacaacgcccagttctaaaataattttttatcatgtttgtttgtttgtttagtgtgcatgcatgcaggcaagcaggctcatgcatagatgtgtcataacctgcatatggaggtcagagatcagcttgttggagttggttctctctttctacaatgcaggtccctgggattaacagcagatgcctttaccagctgagccatcccaccagcccacctcctttttctccttctaaaagccttctcatgaccagaagaaaacattccatagtcttcctccctattttctggctcttaaattcctttttctcgtctgcttttgagacgttccttgactcttaaagagcaggctgacatagatgtcttttttttttttttttttttggtttttcgagacagggtttctctgtgtagccctggctgtcctggaactcactctgtagaccaggctggcctcaaactcagaaatccacctgcctctgcctcccaagtgctgggattaaaggcatgtgccaccacgctcagcgacatagatgtcttatttagggctgagcactcaacagccacttattctcagtctcttgtctcagaagttaatgtctatattaactgccgccaactgctgaaagatgcttctctggccaaagtttagagctacattaatttgtggagcgcattgcaggcacagctactctgagctatgctaagctgaaaggtgatattctcagagtctacaaatgctgtatgcaggagaagtaagagctgctattctctggtgcttgtgtttttggggttttggtgctcagaggtctcctccaactcattcaggctgttggaagaacataattcccaatggctgcagaactcctgaggctatagctccatttatagtctttatccacttatctagtgatggacacagatttattccatatgttggttatagagattaatattaatacatatgaatgagtatgcagatattgcttgggaatacagatttcatattctttggctgtataacaagaagtagaaaggctggactatacagtagttttatttatatttttaaaggaccccccccccatactgtttgacccaatggctatattttcttgaatatttgtttgtgcagttttgaaacaaggtcttattatgcaaccttgactagcctgaactcattgtatagaccagtctggcctcaaacttacagagatccattttttttcttccttaatgctatgattaaagatggcacaccactgcacctagctcacaaaggctatttaaaaattaaattctttaatagctcctgaatcttttgagtgacttttagtccttttcaccttatattggcctttcttagccccctttcttcccaacaagtcctcctactttcatgtttttctgtgtgtgtgcgtgactcactcagcttagttagagttccttgcatcctgactattttaacttacactcccctcaacactgggtaaatgttgtcttttctccaaatccactgtaatacttatcctttacgtttttgataacaacataacatgtctgtgaaacagataggcttattaggctattttccagtttttggcttactttatattttataaagatgattatttgggggcagttgtgaggtagttaaataattattgatctatgtactatctgtggtggtttgtatatgctcggcccagggagtggcactatttggaggcatagccttgttgaagtaggtgtgaccttgttggagtaggcatgtcactgtgggctttaagactctcattctagtttcctggaagccagtcttccactagcaaccttcagatgaagatatagaactctcagctcctccagtaccatgtctgcctggatgctgccatgttcccgccttgatgataatggactgaacccctgaacctgtaagccagccccaattaaatattcttataggagttgctttggtcatggtgtctgttcatagtgaataaaacccaaactaacatactatctataaatgtaaaattcattgcatgtaggtgaaatatagaatagtatacaaaagagcacttaaatgcttattatcttatttccatagattgattgagtaatataataatttgatacatatacacaatgtgtaatgataaaatcatggtaattagcatattactttcctcactattattttatttggagcctgtgaactcctatcatccagtttttcataaactgtataacatattattgtgagctctttttgaaaagttctggaaccttaaaacatattaaatttatcttcccacctttgggtattcattatccaacctcccattagcctaactaacctctccctccttggtctctaataaaacaaatccacagttcaattaactctaaaatattcatatgagagaacatgcagtctgcatcattctgatttatttcacttgatgtaatgtcttcctgttgcatctacttagccacaaataatagattatcaccatttatgattaaatactttttttttaagacagggtttctctgtatagccctggctgtcctggaactcactctgtagaccaggctggcctcgaactcagaaatctgcctgcctctgcctcccaagtgctgggattaaaggcgtgcgccaccaccgcccagctaaatacattttgttgtatagatgtgtacctctttttctttattcatttgttcatgggcatctgggttattttcatattttatttattgtgaatagtgctataacaaagtggaaatggaggtatctttcagatacagtaatatcatttaaattggatgaatactcaaagtatagctagatcatatgatacatctattttttaggtatactggtatactggtttacatttctttcagaaatgcctaggagttttcttgtcagcatctattttttttccttgaaaatatttttgagtgtatatctgtaatcctagaagtaagaaagctgagccatcaagattacaaatttgaagccagtctgggcaatacagtgaattccagcccagcttgggtggtgtatcaagaccctgtcttggaaaacaaacaaacaaacaaacaaacagcctctgtcaaactccacaaaaacaacagcatgaagttgagtatagatacacacatctacaatttcagtacttgagaggtactaaagcaggaagattaggaactctgacttatctttggctatatgtagcaagttcaaggccagcttgagctaccccaaaacctgtctcaaaaacaatttaaaaataataattgctattttaactgtgatggaatttataatgtgacagaatctcattatagctttggttcacttctaatcattttcatgtgtttattggttatttgtatctcttcaattaatgatttatccaatataaatttcatcagttgatttttttttgttattctgttaaaaaacaatcatctgatgctctgtgtattcattctctgtcaatcgtatagccagcacaggctttctccattttgacgttgtgttttcacagcaaggatgctttggtttgctgtgtaggtttgccatctttgccttttttaaaaaaaactctgctctgtgctttggagtcccatccagaaggctgtttcgtcgcatatattgagatcatgcttttctgtggtagtttcagatcttatgttaagatattctattcacttgtgttgattttggtatggagagaaggggtcaggttcaattcagtatatatgaatcaataccatgttgaaatcttttttaaagaacagttagttataactgcagttattcctaggttctttaatccattccattggcctatgtatctatttatacaccaatggcttgcttcacacatggttactatcattttgaatatataaagcatgatacttttaaactttgggttttttctttaagattactttggctattttgggactttctgattctgtatgaattttaagactatcctagctctgtggacaatatcattagtattttgatggtgattatattgaatctgtaaattttggggggtagtatggacattttaaaataacaatgcatctggtttatcttcatatatattacttcattagaatattgtactattgcttgcttttgatatggggcctctctatgggtctcaggatagttttgaacttgtgattttcctgggttgagcatgaatatcaggatgggaactatgtagtagctaaagatgctcatcttatgttatccaggaagcaaagaaataggaagtgccacagcctccttcaaggtacatccccaatgacctaatacttcctactagattctccttcgagtattctgttaccttctaataattctacactgagaattaaatctttaatacttgagtcttaggggcaggactgattctagattgaaaactatagcactttgcttctcgctcccaaaggcttacatccatgtcatattcatattgcaaggtgtgtttagtccatctccaagaatactcagagtcttaaaacatcccaacattgctcaatggaccaaatccaaagtctcatctgagactcaaggtaagctcttagctgtgagcgcctgcaaaaatcaaaagacaaaatgtgcacttcaagaagcaatggcacagagcaaacattcccattccaaaagagaggaacaggaaaatatgaaagatagatcgaaccaaacaaaatcaagatgtagcaggccaaatattgaatcctaagtgtattcacctaagtgtattcaaatattgacacctggcccatgctgaagtaagggttgggcagttcgactacagccttgctaggtgtagttcacatgagcctcttctccaggcagtttcccgtgcttcctttagatagctgcccctgttgctgacatctctttccttccggggtctctcatgatgctttggctttactttcacatctccacataccaccttctcaatgggctgcttattacagtaccttgaaccctgctgcacactcactgaccttaaagggagaatcaccagcctttcattgttaaatattatacttgttgtgggctcattttatgtggtcttgtattgagttacatttcttgtttgcttgatttgttgagttgtgttttttctcttgaaaggacaatgaatcctgtccagagagcttttttttttttttgcattattttagattattttagatcatcaaatagttctgtgctcatcagcttcttttcttacttttctctctttttaaaaagagttatttatttattgtattacatttgtacactgcagctgtcttcagacacaccagaagaaggcatcagatcccattacagatggctgtgagccaccatgtggttgctgggatttgaactcaggacctctggaagagcagtcagtgctcttagccactgagccatctctccagccccattttcttacttttctcaatgcagccagaagaaagctaatctcactataatcattattttttggaaagatattttaagagatcattatataggcatccagatcttgccttttattaatatttgactaaagagtatgttgtatatctctattgcatcaccatggaatggatgcttttttgccctttttagcactgaaattagtaatttccaggaaaaaacaaaaccctgaaccaactcagaaatcagcaccaaaatcggtagcagtgttttgaagctggcattgcatgtcacaggggcaaaattctcttcagggaaacctcaatttttcctttaaggcctcatcataaacacacgcgcacacacacgaaacacttaagtcctgaaatctacagaacaatgcttaaataaatctaattgacgcaaataagtaaacagagaagtgacatgtatccgcgcattgaaagaccacgtgtcaatactagctagctttctggcctccgtgccttgtgacacgcagtggcagcgctttaggtctgctgagcgccacccccaccccccgtcccccaccccccatgggcgtcgaggtgaggttgtcagggcaaccaatgcggagcgccactgagtgctgcagccaagctgtaatgttgcagtgctctcagccttcaaacagtacctcaggtccagccctgcagatcaaccaatgtcgcgttctcactgaaaatctagcaacaatgatgtacgattgtagctggagtgttgtcccccttctaacaacagtgtactttgaaatgtggcaagaagcatttggctgaaacatttgaggtccacatctgcttgcgaaattctcaataggggctggtgtctgtgaagtacccgctatgctcctgcagattagtcaccatcaacaacctaattttgcgtcaggaaaatgaggcgttctgtctttccgaagacgcttccttgtggctttctgcgattgtcagtgtgaagttctccactccaatcttattatcagtctcggaggctctcatccttgtttgctttagtctaccaagctgtggcctacaggtgccagctgtggaatgccctggcttgcacttcctctttctagaagcttaaaaggcacaatcctctgtgagagcccagcaccttgagggtctcctgtcacgaaaccttgacaacatgacagtgaatgatggtgggggaattcttagagttatttcagctggcaagtctacagtacttcatgaattcatggaaagaattgcagttggtttcatctgcattaattactcaggaaggctgtgctttgttatgggaacctccatttttgattttagagacttgcagaaaatacaggcagatgatttggaggaaaatggggccctctcttggggttcttagtttccttaacaaaagcatttaagatggactcaaatggaagctcgaggacagttttattggagttaaaaaaaaatccatgtcaggcaagccgtaaccggtagcagctgcccagaggagaaggcaggagagaagggaaaagccacgtgattgaggttgttatggagcttagtcagacacacgttgaggagaggagctttagagaaagagcgaggaggcccaaaacgtcagaaaaaaaaagtactgaggatctggccagcatctgaaggagacaggaaagaaagaaaaagcagaagttgtatatctgaaggtcgccagactcagtggaacgtcatggtggcccataggggttgctctgagggaaggagctgggaattctgggaaagagaaatacagtagttcattaacgaaaaaaattctttagcctatttctttagcatgccttaaggtaagtccaagttcctaggaatgggccttagctgggtgatttacctagcacaactgggattttatgtctctacccaggccagagagtctattctttcaaccagagtaagttttctcttaatgggagtttacagctattctaacagtctgtctgtaggcaatatgccttagtgaaggagagaggcctttgtctttgggaatgttggcactgaaatgctcctgcaaaattactgagcctctgtagagggactgtggaaaccaccagctttggtttgttgctggaaacagatgaggtctgtcacatacacttagaagttgtaatcaatagaattcctcaaagagtgggctctatttgtggtgggaaaattgcatgttgaattgggcagtgaactgaactggaaggtgacaggaactggagtattccagactggtttactttgtctttgtaggagggccagagcagatttccagggtctttgtttgctggcgggcagacaactcggagagattaaagggcaatcaagatgaagtctgtaagcacaggcatttggatgggagtcttttggtcctaaaagacaccaggatagtcccatggctatgtgaaaagactccaggaggctttgagaccgtatcattccctcagtacttgccagagaccctgagcaatcgctgaactgaaagaactgtgtggcaattcttatcagtgtggagaaagataacagtgattctaagcagaattgtttaaagatcaggaaaagcttgatagcaatctctgtgtaaatccaaaacaaacaaactccacccctccccaagatttggcagtggagtaaatggactttcaagagagttctctgctgacaatttcagctgtagcttgtgtggcttttcttgatgtttgcacaaattctccttcttaaaaacaactgatctgtagtagaaacaggttttctttgtatattaaaagatagtttaaaaatcgcaaattgtttcataacaggaaaactgtttctacgtcctgatccattgttggtaattggcaattcatcagtatcagttttcttaaaactggaagtccttcaaaaatccagcctagtaactcattgagggtcattacaagaagacttacttgcttttatttgatgtgtttgctttttatgctgcatgtgtgcctggtgcccaaggaggccagaagaaggcattggttagcctgggactaaaagtacaggcagctggggctgccatgtgggtgctgggagacaaaggccagcatgctgcaggagcaacaagagctcctaaccactgagccatccctccagtctgtttcctttgattcttacctggcttgccaaattgctcttcatccttacgtatgatagttacagaaccaaaaaaaaattttcatacaacgctgtatggtcacttacatgaatgtttgccactttggccaaagtttggggtttctggaactaatgtcaaactttgtagctatttggaatgatgtggcactcggtcacgaaaaagaaccagcatagccctcattttgggaccatggctccaaagacattaatttaagtaggagactgatatctatgactttttctcatcttctttcttttatttagtaaagcctgactgactgtaaggttatagttttagcattcctattaaacactaattgccgtgagaattaacagaagtaaacactttatcaggattttactgccttgaggaaggatatttctacatcattgacacttggaaaaaattaattctgctttcctcctctgtttacataatataataatttaaatcacagctgatattcttctgtagaagatatgctcttatacgtgtgtgtgtgtgtgtgtgtgtgtgtgtgtgtgtgtgtgtgtgtgtgtgtaaaatgatggagctataactggagggacagcatgtgattaaatttttaagtactctagaattatatactgcaccagagaagagagaaaatagtgtatatgttacacattgtaaaggacttgtctaagtttaatgaaaaattctcagaattgtgttaagtttttgaaataccagtgtcagagaattccattactaactagcccataaaaataagcagatattaactatatgcagatttttatttgactgtctagcttatactttcgatttaatctttacataatgaaacacaatgatgaggtataagaacaaacacataaagggagctggagaaagtattctggggttaaaaacatttgttgctaaattacagggactggtgtttgttgaacaagcctgccattctgtaaacacctgggtttttttggtttgtttggttttcttagtttttcaagacagggtttctctgtgtagccctggctgtcctggaactcactttgtagaccaggctggccttgaactcagaaatccacctgcctctgcctcccaagtgctgggattaaaggcgtgcaccactgcgcccggctgcttttccattttttaagtgaacttacatactaaaaatgaatttgatcatggcattgtcatacatgtgttgttatactttgttcaataaaaacagattcccctccccatctgcctcccacattccctgcctctccttagtctctgacctctttctttgtctttacatctggttttgggtttttgggtttttttgtttttgtttttgtttttttgagacagggtttctctgtgtagccctggctgtcctggaactcactttgtagaccaggctggcctcgaactcagaaattcacctgcctctgcctcccaagtgctgggattaaaggtgtgcaccacatctgcttttatgtaatccgatgccctcttctcttcctctctctctcttcctctctctctctctctctctctctccccctcctctccctccccccctctctctcccccctgtctgtctatctggttttacctcacacatgctaggcaagtccttgacaaccaggctacacctcagcccatgtcatttgttttcttgattacagacattttgactgggatgtgatagcatcttaaggcagttttcattagaattccctgatggccaaggatgttaagtttttcaattatttattggctcattgcatttcttcttttgataattatctaacatcaagctgctacacttctctttctttcccatctctccaccacatagttgcacatgtggtgtgcaacttagttcctctttgggagaaggaattagtgcatgtttcattgttcaagatgcatcatgttaggagaaattatgatccaattattgactttgagattaagtatttctaaggtgatctaattacctcagatgatcaccaatgacagaccaaagttcaattacaccttcattggaaaccagtttggtgaaacctaagatattattgggctttcttatggagattagtgtggcaatctcttggaagctgtgttgtggagttcttaattaacccttgacttcctgtgtatattagagatctcccaagagcacctgcagcttgagagggaaatagctggaatgcctagggagagtctttcttagtgaatgtcaatagctccattaccattaattaccatggcatcttgtttatactcagaggaaaaaacactatgcacacatacaagtgactagaatgttattcagagaatttttccttcctcagcatggactcattcattcagttgaagacttaatttgatggagaaagcctgatttgcaatgactaggagaaaattgcttgtatctgacagattcaaactaggttagtgattattcttccagctttagttaaatcttactgcattagctaggaaagagtcaaactttataagtattaaggaaggctgggtgaagctttctagtgaatgttcttaaacacaaatatatttgttggcctggagagatgactcagtagttaagagcactttctgctctttttcctgttagagagcactttcttttctaagaagagaggacttgggtttggttctttgcacccatactggtgggtgatgacttcctgtaactcctgctccagggacccaactattctgactccatagacacacagacacacaatttaaaaaataattcttgggggctggagagatgataactcagagattaagagcactggctgctcttccagaggtcctgagttcaattaccagcaaccacatagtgactcacaaccacctataacgagatcgggtgccctcttctggtctgcaggcatacatgcaggcagaaggatgtatacataataaatcaatctttaaaaaaaatcttaaaaaaaaaacaagtgtgtactgcatgagttcagttcctggaatccattaatggaggaatacaaattgtagttattatagagactattacagaagtttctctaaaattaaaaaatgtctatgatactatctggctatcacacctttggatacctatgcaaaagcaatgagatcaaaatgtcaaaatgataaatgcattcaagtttattgcaatgcttcataacagctaaggtattaattcaacttatgtgtccatcaatagattaacaaataatatattactttaatgacatatataattgtttttggtttttcaagacagggtttctctgtatagccctggctgtcctggaactcactttgtagaccaggcaggcctcgaactcagaaatctgcctgcctctgcctcccgagtgctaggactaaaggcatgctccaccacgcccggcttatataatagattattattcagccataaataacaatgtaattttttttgcagaaaaatgtatagaacaaatggcatgccattagctgaaataggttataagtaccaagtggtctttcttatatatggaagcaaaaatgtcaacctaaatgtagaatagtattattagaggttggagcattggagagaagaagataggcaaagactggctggatctgagcatagaaggttatgtttgtgtgttgagatatcacactgaaagttactaatacttaacatgtacttaataattataaaaataaaaattttaggtatgtataggaagacaagtgttttttaacatactgattttgtgtcctttgactatatacctagtagcaggactgctggatcatatggtacttttgtttttatgtgtttttgtgaaaggatctttaatagtgtgttcataatggatatgcttaagttcatatgaacagcatgcaaaggtaatctccattcttgctttatttgtcctcttttgatagtgggctttgtaagaaatgaggtgatacttcagtgtggttgtcactttcagcttcctgatgaaagaatgacatggactaccttttgcacaggtgttaatttatttgtgtgtcatctttgatgagcatgtattcaagatcttttaccacttacaaatcacatttttttctctattgaattgtttctgtttgtcctacaatagctgtattcccaggcagatgtctaggtacctgtagattaactcttcattctgttggttgttccttttctatgcagaaatcacagtttttcagacaaatacaaaacaatataaataaactccaagatctaccaccatcatcatcatctttcctactcagctctcaaggtggagggattttaagtcatttgctagagataggactcaggtctgttggcttagatgtgagaggatctggctttttttttttttttttttttggttttactgcccagcaacagacaacatctattcaggacttccgaagcttctgcattatctgtaaaatggtgttctccattacattttccaggagttgacgtgagaaggctttgttgaccaccatgtggccctcctggtgggaagaaggtacatttttcactgtgatgtcacttcattaccctgcccctcttatttcctcatttaatcaatgtgaaggtgacactcttatccaggttcactaaggagactcaagactagcttttttgtcttgttctgtttttttgaatgctgatgctttttcccccctaggaattatgatgtctaagaaaagagcttcctactttgtctagggttttgaggtcttatctgtcataatggagcaacagactctttttaacatttcacatggctttgatatgcagcagggttcctcctcagccctcctttcttcaagggttatattgcaaggaaaggtgaggattttcgcagcaaataaaagggctatcctagtctttattgtttttagggaataaaacctgttagaagggaggtgtttatgatccattggttacactggaataaaccttactggttcctttctctcatcaatttaggtctggcctccggttgatatataattgaggaaggtctcataatctttccaggagacctggattctcttctttttatctgaagaacagtgagaggagggtggatgggttgctggggagtaagctttttagaccagtgaaagagagggagagagagagagagagagagagagagagagagagagagagagagagagagagagagagcagggacacaaaatgctttctcttgtttgccacagacctcactattccatcagtgtgctttaccgaggaggaggaggaggaggaggaggaggaggaggaggaggaggaggaggaggcggcggcttgaagcagatggattatgcctgtgtacaagtgcatttttgaagcttccctgaacacctttcttgctttaaaatgcaaatgagagataacattagaggtacaagagaaagttcaagatttttaaactaaaaaacaaagcaaaaccaaccaaacaaacaaaaacaatctttttttttccttagatcaaaaagtttaggggcagggaaccaaagaagaaatacaataaccctagtaccatatgctaactaaccagtttctatattcaggaccagaaaaccctgacagctcagctaggtaacttaaagctgcatgctgcacatttcttgcaatgtttccttagtaatcagggactcacctatcaatggcttgaggtgggaggaaaggggaaggagaaggaagtgatcatctattgtagaatttgctttatttgctttcctacttttattattttgagcacctttaatacaagtaagtgtgtgtgtatgtgtgtatatttaaactttattataaaaatattgcaaataaaatgtcacacactgaaattagccagactcaaagacccaatgaacatctgtacactgagagcagccatttcaaaccaaagtcgcagagtttcacattggattatatattttcactgttgaatctatgttatgcacctattcaccaccaaaacagcagaaacaaccgtgacagaattggaactagaaaaacaattagctttatgtccccttcataactcgtggccattgcctgtgttcaatctttcctcaacccataacatttagcctttcttgttcactttttcttcatgttaaatcgtccccacatgtacatttgttatgtagatattatttcctagattctgaatacaagggagaatatgtgggctttttttctgagattgtgtgacatagtataaattctaattccatcaatttttttttgcaaattttgtgagcacatctttgtttttctttttttataaccttctatcattatttctacatttgtggcactgctcagttcttcatgctgcccattagcccttcaataaaggttcaccctaactattgaccaggagctcaagtcagttttcttactataaaacagagctgttgagtctcaagaaagcttgaattctcaagggagaatctatgattctaagttcagtgttctataaatgaagaagatgggaaatcagggtgaataaaatagaatatgttaaaaatgcaaatatatggttgagatgggaaaccaatggttatggtttgagaaaggatttttaaaaactttttagttaagcaaagatgacttaactacttattactctttcgagaagtagggcaataaaacattacttgccatcagagaattagcaagtgattaatgtgggagatgggagttaatagcagtgtttaaatatgtaaagatttatcaaaatagcatcagcaaagactgaagtagagttttctgtagaaagatctaaaagggactacatatgtgtttattttcccccattactgcttgctatgtctgctattaaatatactcttccctttttcaaatacataaagagagaagatgtactcagctgtttattatgtcttttgtttgtttgtttttgaggtaggctttcattatgtagccctggctgtcctggaatttgctctgtagaccaggcttgcctcgaactcagaaacttacctgcctctgtcttctgagtgctgggactaaaggtgtatggtattgcacctagctcaagctgaataatttatatggggggcactgataaggatgaagtcagggtgtgacccatacttggcaaataatcacttagcaacatccttacttcctgtaccgcactgtagggtaagtgtttaggggcctctaaatttgatgatttgagtaatttcaaaagcctatacattcctggccccactttagtccaagtgaatcagaagccctggcattaaaaacaaacagctaggactggagagatggctcagtggttaagagcactgacttctcttccagagatcctgagttcaattcccagcaaccacatggtggcttaacgccatctgtaatggggtctgatgccctcttttggtgtgtctgaagacagctacagtgtactcagatatattaaataaatcttttttttttttaaacagctaacaaaacaggcctgttatgctcattatcctgcagtctttctggcacatagggtaagcatcagataaatggctagaagatagatctcctacttctgtgctgataaaggttttgttttggaaatgtttcttgtgaaacacatttaattgggaatcatgcatttcatctgacaaacctacaacatctacaacaataccagaaagattgctctctagattattctcttgcagcaacaactctggggacaatattcttggggctaaggctcctaagataaaggcttctagaagcaacaaccctgctattttagttttattttattctatttcttcctcctgccttcatgttgttttggatatttgagacagggattctctgtgtagccctggctatcctggatcttgctctgtagaccaggctggcctcgaacttagagatccatctgtctctcatcctaagtgctgggattaaaggtataagcaccactgcccggctagttcctattgatgacctttattataagaaacatcccaccaacagcaataagatagatgattttttttctttttcttttctttggatatttcattatttacatttcaaatgttttcctctatccaggtctcccttttggaacaccccccccccgcctctatgagggtgctcccccacccacccacccactcccatcttccccctacacaagggcatcaaaccccctcaggcccaagggcctctcctcccactgacttccaacaaggccatccactgccacatatgcggccaacgccatttgtccctccatgggtattctttggttggtggtccagtccctgggagctccgtgggagggggagatcctactctgttgacactgttgatccctccatggggattaaaaaacccctcagctccttcagtcccttctccaactcctccattgccacccccccccccccccccccccccgtgcactcagtccacctctgtatttgtcaggctctggcagagcctctcaggagacagccatcattttagggaactcttaagatatggcatcgttctgttagaaataaacattttttaaaaaaataagtactctctggtgccacgttacttaattgtgtttaaccatccacagttgtgtattttatttaattatttttgatatatatatttctccctttcctccctccaaaccctcccatatacatctcccatatccactttcccactactttaacttcatggcccttccccccattgtttttgcatgcatatatgcattgcattgccctttttatatttttgcaatgagttttagtacatcatgagtaaatagactaaatgtatcatgacttttaagttttaaagatttatttattttttaattggctattttatttatttacatttcaaatgttatccccttccctggtttcccctctgcaacccccctatcccatcccccctccctctgcttctatgagggtgctccctcacccacccactcccacctcaccaccctagcagtcctctacactggggcatcaagcctttataggaccaagggcctctcctcccattaatgtcagataaggccccttcacctccttcagtccttccccaaactcctccaaactcctccattggggaccctgtgctcagtccgatggatggctgtgagcatccacatctgtattggtcaggcactggcagagcctctcaggagacagcaaggacttcttggcgtctacaataatgtctgggtttggtatctgtatgtgggatggatccccaggtgggcagtctctgatcgcctttccttcagtctctgtcccactttttgttcctttatttcctttagacaggagcaattctgggttaaaattttggagatgggtgggtggcacatccctcaaccagggaccatgcctaacctctggatatggtctcaacggagacaggttctctctctcctttgttagatatttcagctaatgtcatccctgtggggtcctgggaggctcttgctttcctgacatctgggactttctggttgctacccccagttccccatcccccattgctacacaccattgttcaatttcctgaccctctgtaaatttcctccatgtcctcccatacttggcatcttctactctttttcccctccccctcttctcttcctcccaagtgcctccaatcctctaacttcccttgattattttgttccccccttctaagtagaactgaagcatccgctctttaattcaggtattgtattttaaaattactagatctgtgtgagttgtgattttctttttcttttcttttcttttcttttcttttcttttcttttcttttcttttcttttcttttcttttcttttcttttcttttctctccctctttttttttgtttgttttccgagacagggtttctctgtgtagtcctggctgtcctggaactcactttgtagaccaggctggcctcgaactcagaaatctgcctgcctctgcctcccaagtgctgggattaacgccgtgcgccaccactgcctgactgagttgttattttctaaacaatatggtgcacatgcgtgtgtgtgtgtgtgtgtgtgtccctatgcatgttcctgtgcatatatatgtatggaggccagaggacattgttgggtatctttcctaaggtggtgttcacgtttttttggagacagggtctcttagtgaactggaacttgtaagactagactggctggccaatgaacctcagggacatccatttctctgcataccaggcttttacttttttaaatatgtgatctggtgagaatttttgtcctcattcttgcatgacaagcattttactgattgagattatcttcccaggtcctgaaatattttatgtatgtatgtatgtatgcattcatacatgcatttatttgcagactgggaattaagcgttctgccaccaagctacatgcttagctctttatttttatttttagatagaattttactaagttgcccaggttaggcttgaactactctgacttcaaacttgagatctgtgaactcaggatctctggaagagcagtcaatgccctaaaccactgagccatctcttcagccccagagacttccatacacacacccacacacacacacacacacacacacacacccacacacatatatacatacatatgtacatatatgtgtgtgtgtattacccccccaaaaaaacaaaaaatagcatcaataaatgtcaaataattatggatatttaaaaatgagcaaaatatctatttggagaattttactggcacatgcctttaatcccagcacttgggaagcagaggcaggcggatttctgagttcaaggccagcctggtctacagagtgagttccaggacagccaggactatacagagaaaccctgtctcgaaaaaaccaaaaaccaaaaaaaaaaaaattttaaagtataccatgttctgcctttccttgggcacagtgctattgtctaacttcaagtgactatccacatacatagtcctgtgatttcagaatactgaaagtaaaaccagacaaagctcactaattcatgtaagttgtggttactattttatccaaatgcctaagtcatttggggtgtaacttcttataatcatctatatgttcatgcattttacttacagtgttaattaaaattttcatatattggaacttaagttttaaagaggttagatgaagttgtgtcatttagaattattcattcatactaaaagaagccaggaagtggtggcatacccggttagtcccagcactctggatgcagaggcaggcagatctctgtgagttcaagggaagcctgatttacaaagaggacagccagggttacatagtgaaacactgtctcgaatcgaatgaacaaacacacatagtaaaataaggcaaaaattagttctttgctttttttaatttgactttcataaattccagtgagatactgttctcatttactaattacaaccaaggataggcaacaggtttttgttaactatagaaaagctgtgtttaatagtaacgtttagcccactctggcagtgacacggcacagagtccaagtgtcacttaaacatgactcccatgccagcccctgatctggccacaccaactgctgtgactcctgtaccaataaacttggcccttgtagcaaagtcccaggagacaaaacctgtctggaactccgcttggccacttggagaagggagctgcttcaaaaaaggtgtctagatggagcctatactctactcagaacagaggcagactcaggcctaactagatccctgcacaggagcagatcagagttcaagaaacccaaaccttggtctgcggggggggggggggtgttagcctaacaaattgtacaaaactgccacctggtggcctgaagtggtcttaccagtactggaattaaagagagacattaaaaaatcttgggatgtgtgtgcgtgcgctcgtgcacacgtgtgggtgaatgatgcatgcacatgcaaacaaatatggatgtcaagtgccttactctatcactatctatattattttacaaagcagactctccttgaatgtggggctcaccaattggcttagactggctagccaagcaagctcttgcgatttcctgtctttacctccagtgctgggattacatatgtgcgttgctatttttagcttaaaaatattttatgtgtattggtgttttgccttcatgcgtgagtgtcggattccttggaactggagactggagttgcagacagttggtgagcggccatgtgcgtgtggaaaaccaccatgttttgatcccaggtcccccggaagaacaccgctgagtcatggcttcagcccctagtcttgagtcaggtcctcatgcttctgcagcaagcactttacccactgagtcatcttacaagctctttggatgattttaaaaattaactaatttattaactaattaactaagtaattaactttacatcctgattgcagcttcctctccctcctcacctctcctcccctactcctcagaaaaggggaggtctctctttgtatgatttttatatgcagattcatgtctcatatcttggagccatgtttatgggtgagcagaatagcagataccaataaagtttataagacactgagtgatagatgcactgtggactgaaacacattgagcccttatatgaacgggtccatcagtgctcttgcctcatggagtacccgcgaggtctcttttcttttcctagatcacatttccaactgcccttttcttctcttttgaatctggaaattccacgtggtatctggctgttattctacatttgggaggtagaggcaggaggatcaggagttcaaggttatttgtaacaatgtaccaagtttgaagccagcctgtattatgtgagaccctgtctcaaaaacattaaaaatattttttgcttggattaatagtgttcagaagttaggatggataataaacatgtcaaaagctttcttcaatatcattcacctcttgagattatatataaaaatcaaatgaatggaggaaatagcttaatgacagtacttcccatctgggctcatcacacatttgtcggaaaggataagattaaaaattcaaggaactgggagatagtgtggtagtttgaatgagaatgcccctatgggtagctatttcaatactttatccccagttggcagcactggttaaataggcttaggggctgtgacatttttggaggaagtgagtcactgaaggtggacttagttttgaagtctacgtgccatttctcccgtgctctcttgcttcctgcttgtggcttgagatgtgagctcttggctgttcccgccaccaagtctgccacctctgccacacttttctgccttgatggactctaaccacctaaaaggataagtccaaataaaccctttattctgtaaattgccttggtcatagtgtcttatcacagtaatagaagatgaagacaggtggtactaggcagtgggggactgctgttgacaggcccgactatgcagcttattggagtgatgcggaatttcagactttgtactagcaaagtggttgaattatgtaagcagggcttaacatgccattctagtaggagcttggaggacagtagagctgagagaaacgtggactatggaagcctagttaaagaggtttcagaggggaacacttaccaccaatcagactagacccatcctcatgatattttcacaaagaatctggctacttcttgccctagtaccaaaaatttgcctgatgcaaaattaaaaaaaaaaactttttaaaaaagagggcaccatggcacacacctataatcacaggaggcagaggcaggcagatctctgtgagttccaggccagaagactactctataaaatgagtcccagcacagctagggctgttacacagaaaaaccctgtctcaaaaaaaaaaaaaaaaacaaaaaaaaaataaaacaaaaaaaaccaacaacaacaaaaaatccccaacaaaacaaaacaaaacaaaaaaaaaaaaaaaggaaaagaaaaagaatgcattaatttctttgttagagaagattttaagacagccaaactctgctataggatgcagggtgatgaatatggatctatttgcattcttcttcatgcagacacctaattagaccagcatcatttgttgacgatgctcttccttttgcattgtatttttctggtgtctttatcaaattataggtgttcataggtgtgtggatttatgtctgcatctttgattcctttaatcaacttttcttttaaaagacttatttattttatgtgagtacattgtcgctgtcttcagacacaacagaagagggcattggatcccggtacagttggttgtgagccaccatgtggttgctaggaattgaactcatgacctctggaagatcaatcagtactcttttttttttttaaagatttatttatttattacatgtaagtacactgtagctgtcttcagaccctccagaagagggagtcagatctcattacggatggttgtgagccaccatgtggttgctgggatttgaacttcggaccttcggaagagcagtcgggtgctcctacccactgagccatctcaccagcccccaatcagtactcttaaccactgagccatctctccagccccaacctctgtttttatgccaatactatgtggattttattacagcttgaaatcaggaatggtgaaacctctgttcttctattgtacaggattatttaagctatcctgggtttttttgttcttccaaatgaagttgagtattatcattttaaggtctataaaaattgtgttggaattttgattgagattgtattgaatctatagattgctttcgacaattttttactatattaatcctgccaatccatgagcatgggagatctttctatcttctgagatctttgatttctttcttcagagacttgaagttcttgtctttcgcttgcttggttagagtcacaccaaggtattttatagtttgtgactgttgtgaagggtgacagttcacaagtgctgggattaaaggcatgcactaccaccgcccagcagcttgtgtatttttattaggaaattgagtccattgatattgagagccatcaatgaccaatgattgttaattcctgcttttgttttgttttttgtttttgtttttgtttttttgtttttttttcgagacagggtttctctgtgtatccctggttgtcctggaactcactttgtagaccaggctggccttgaactcagaaatctgcctgcctctgcctcccaagtgctgggattaaaggcatgtgctatcacgccctgctaggctgtttgttgttggatgtgtttgtgtgtcagtatgtgcttcccttatttttggatttgctgttatgagattatttattttcttgggtatagttaacctccttgggttggagtttcccttctagtaacttctgtaaggctgaatttaggactgatattgtttaaatttgaccttatcatggaatatcttgcctttgtagtctattagtgtttgaatgacatctatctttctaggctcgtctagctttcaatgtctccactgaggtgtcaggtgtcattctaacagctctgcttttatatgttacttgttcttttccccttgaaccttttaatactccttttctgtatgtttggtggggatattattattattattattattattattattattattattattattattatgtagcagggccacttccttttctgggccactctatttggtattctgtatgaaaaactaactttagtaagagaagaagtaaagtagcaaaagaagtcttcatgctatcagggactgagggactgtacatgatggagaggggttaggagaggaagaaattggacctggggggcagggaggttggcaaattagcacaaggaggaggaggaggaggaggaggaggaggaagacagtcaacttaatcatagagagatactagataatatatctttaggttctaatttttcttctatttccagctctcgttccactttttaaatcactttcatttttaattttaactgttatttttattgattactggtttctttctttcctttttaaaaaaatatttattttatttatatgtgtactctatagctgtcttcagacacaccagaagagggtgtcagatctcattatggatggttgtgagccaccatgtggttgctgggaattgaactcaggacctaggaagagcagtcaatgctcttaaccactgagctatctctccagtcccaccccccttattttttctttcaaaagctgaaaaacatcactagggattttcttgggttcccttgcacctaattcttcctgaagtgctcttccctcttcagggaaagatggcagatgctaatgaactccaggaatttcatcaactgatggtgtcctgctttaactccttcttccaacaacaaaatctgcagaacttctgcaagccaatgtcacgtcctcaatcctacctgtttcttgttcttgttgttatgttgttttattttgtttgttttcgagacagggtttctctgtgtagccctggctgtcctggaactcactctgtagaccaggctgtcctcgaactcagaaatccgcctgcctctgcctcccgagtgctgggattaaaggcgtgcgccaccatgcctggctttacctgttccatttttacctccagtgaactaatctcttgtcttaatattccaaaatccaggaattcctcaccttctttcttcttttttctctcttttaaactcccatatttgagatccctgttcaggcagcacctataagtgctggcacttacttaccaaactagggcattctgattatggttggtggggatgtcatttatcaggtacagattgtagggagggggtcacacaagaatgaggctgtgacaagtttatcgcaagcaatcagtttcccttataagaaacagaatacaatggaggttgccaggatcaattgtagttgctaggatactatgacatttacaagctctacaagatatacaagattaatatctaagatcaattgtcttgtcaaactactatatgcagcattgacttttagggaacaaagcgaaacccaattcagagttggcctgaattgcttcacagcctcagagtgccttgatttttcaggaactgaaaggcaacatagaacccaggtgtcacaaactctaacctgaaaagcctatgacacatgtctctcagggcagttagacttaggccaactccatggttccctgtagatatgttactaacaggaaggcaagtcagtggcagattaagagcagggtttgtagcatggactttctttttcccacagtgttgatgtttccaaaaattcttcctcaagttgctgggcacctttactacttttgttatagagaactggttagagatgacccctcagatatactttatagccaataaaagtctttattccagcaggctggactaactatacttaagaatttggaactcaagtacagctccagatatttaggataaaggattttggaaggcagaatccacatttgaatatcttgatagctacatgggtaggtttgtgcaggcaagcagtgtaacagaagatatgataagcagttagctgaaggtgggagtgctctgtgcaagtaatcaagcaaatagtttaacaaaatctaagatatccagttatctggaggatggtggtttagcagaagccaaggtcagtagttacctggagctttgcaaaagcaagcagtttagcagaagctaagataagctaacttgggaatcttgtccttgggttcttagaatagagttagctattttacacagggcttctcatcaaagagattaaattctggtcaaacctaaaatgttctcaggaagaatataggatctaggaacctttgcaatgtcttacctttaaagaaagcagactggctttctctggtggtttctctggtactaattatgaagaattaaaaggtgtggccttgatagagtgggtgtgggcctgttggaagaagtttgtcatgggtgtgtgtttgttgaggggggagctttgaggtttcaaatgcttaagccaggtccagtgtcactctttcttcctgtatgtgagtatactgcagctgtcttcagacattaggacctggggaggtggctcagtgattaaaagcactgtctgctcttccagaggtcctcggttcaattctaagcaaccacatggtggctcataactatctataatagaatgtgatgccctcttttaatatgtctgaatacagctacagtatactcatatacattaaaaaaataaatcttttaaaaaaatcattgaaaaaaggagaactcttatttatactcccttgcttaggatcttttctccctaaccaccattttgtagcatttgcaatctcacagtggtggggcaatccctagaacaggagcagccttttttttttttttaaaggagccagatcttgtttcccagagaagtctgagttctactggttcctcttcagtaactcctttcagaggctgacacctaactgctgtagggatgggagtgataactactctctggatatgtactgttacgaggaggtgctgttttacggtatatcttagggtttcactcttctgaagagacaccataaccaaggcaactcttacaaggacaccatttaattggggctggtttacaggttcagagattcggtctattatcatcaaggtgggaacatggcagcatccaggcaggcatggtacaggaggagctgggagttctacatcttcatctgaaggctgctagacaaatactgacttccaggcagctaggttgagtgccttaaagcccactcccacagtgacacacctactctaataagggcatgcctccaaatagtgccatttcctgggccaagcaaattcaaatcatcacaggagcttttgaagtcagactgaatgcattttgcattctgatatggctacaagcctatgttaccaagagagtgaaatgtggtggcttgaataaaaaagaaaagtggcacacgcctttaatcccagcactcaggaggcagaggtaggtggatttctgagttcgaggccagcctggtctataaatgagttctaggacagccaaggctatacagagaaaccctgtctccaaaaaaaaaaaaaggctcccagccttgttggagtaggtgtggcattgttctgaggaagcctgtcactggggatgggctttgagttttaaaatgttcaagccaggcctagggagtgtgattgtgtcttcctgttgcctgctgatccagatatggaactctcagcaccatgcctacctggatgctgcaatgtacccaccatgatgctaatggactaaacctctgaactgtaagccagccccaattaaaatttttctttataagagttgccttggtgatggtgtctcttcacagcaataaaaccctaagacaagtgttaattccagtttagaagtcagccactgtgtctcttccatcacggccacttcgtgggaaacactaagagacaaatctaatgaagagaactctttaatgcaataattgaagttttattcagcaagtgctggaactcttgtgtagcaagctaaactgtacaccagagccttgtaatacagaggagatgcctagaaagttcacatgaaagatctgtgagaataactgtgctgttatttcctcccaacagtatatgccacttctcatgcatcaaacgtactctttgttgggagtagagatcagaggtcacgtttggatgaagtcaaggtcccattctcactggtggctaaaccagatttcactctctaactcagtctaggagggaactataatcccattgcgttctgttttgtaagacttcctagcaatatcccgtgggttaaagctgggtgttctgtctgacaatcatatctaatcccatgagtctgatccctgggacctggtatttagaagatgttatgttacaattttgagaagctattttccagaaagaagaggtattataagtggaaaataaacagactttgcctctgcactcaggagagttggagcatctgcccatggatatctcagattccatccaaaataagatatttaagcccagaccttgttggcttaaatgcagtttctcttccaagtagtggtggaggaatattcctggaaaatccattctgcatttcttacccatttctctaaccctgaaatttacttccttaggcctttctcctcttcctgaaataataggctgactttttgttttattccagctagggaggcctttccttcctttcctttccttcctcccttccttccttccttccttccttccttccttccttccttccttccttccttccttccttccttccttcctccctccctctctccctccctccctccctccctccctccctccctccctcccccttccttccttccttccttccttccttccttccttccttccttccttccttcctttctttcttttctataagatattttcttcaattacatttcaaatgctatcccgaaactcccctatactctccccctaccctgatcctcaacccacccactcccacttcctggccctagcagtcccctgtactggggaatatgatcttcccaagaccaagggcctcttagggaggccttttctaaagaaatgttttgttttgaagtgacccagtgtagttgccctgaaatctctagatttttactgatttcccccagtaggtccttactataatgagagatacaactgtgggagaaccttaatccactgtttccctgagagccacacctggggtacctaccagagaaactaggtctgctcaaaatctgtgacctgagtgatagataaagaacctggaaatatcacattggagggtaaatatggtaaacaaagttctgggtgtgccatagaggtttttagccctcacagtaagattaaccctatgatccctttgtattcactgatcaatccaaagtacaaagtgagattgttttagggagataggtagacccagcaggccacacccagcagttagattcatctacaagggaactctatctgggtactgggtattgtttggggccagtagtgtagattacaatggactttacctagataagcaggttcatgaacactacacatgggtatgattgattgggaatggatcttacaatttggaatggccattcctggccaaggggacttagtttattgatggtaacataggcagggatctgacagttttgattcctaacacaaaaattagctgggcgtggtggcgcatgcccttaattctagcactcgggaggccgaggcaggcagatttctgagttcgaggctaccctggtctacaaagtgagttccaggacatccaaggctatacagaaaaaacaaaacaaaacaaaatcaaacccccaaaactccaaaccaaaccacaccaaaacaaaaattcatcagggaagtattgaaaggaatgtttttttgttttttttgtttttttttgtttttttctgggctcaggacatgataggagagcataattgaaagctctcccctttgtacaggttcagggtacttactgttttgctttactcagaaaaatctataccagctactttgatggatgtagaagtagacaggaagacaagttaggacccacccagcttggcctcaaaggacgtgtctccttgagaactttgaccagaactagatttccaggacagaatgagggactacccatctctctccctccaagggctccctgtctaagtccctccaaatgcactggaattggctaaatgtgggatactagctgggtagtgaaggtagttttgctttgttttgttttgttttcttttctttttctttctttctttctttttttttttttttttttgttttgttttgtttttcgagacagggtttctctgtatagccctggctgtcctggaactcactttgtagaccaggctggccttgaactcagaaatccgcctgcctctgcctcccaagtgttgggattaaaggcatgcgccaccacgccaggcaaaggtagttttcttgaaaggaaagttttgacatacaaaaaacctcaaaagaagtcctaatggactctgagtcctccttaagcacaccaaagctaaaggcaacagttttgtccaagcaatttggacctcttgcattaattgagtgagctgtattttgagtaggccattctctattttcccaaaagactggggataccaggcacaaaggagattcagctgtatccctagagttcaagagacttctggtaacttttgtttaagtccattgttgccctatatgcttctacatattgtgaacctaagaattatttcatttaaggcagactttgtcaccttctttaccttttctgtttggcaagggaaggcttcaacccatccagtgaaggtatctacccatattagttgaagatgggttttaggtccccatagcaaatgggtaaaatctatttgctattagttccctgggtatttcccttgcctgtacatggctgagagagaaaggtgatcaatataatggtaagtcttttgacttaataacagacctagtcagcatctctctctgtataaacatccttttttcccccttgggttttgttttgttttgttttgtgtttttggttttttcaagacagggtttctctctacagttctggctatcctggaactcactctgtagaccaggctggccttgaactcagaaatccatctgcctttgcctcccaagtgctgggattaaaggcgtgcgccaccactgtccagctctataaacatccttttaataaatggaagttccctttcctatatgacatatttggtggaaggctttcacatttttcccatgtagaaactaaagttgccatagacaatcattttttggtgacccaccatccatggtgatccaggttccagccttgtccttaggccttctctttcttggagagagtatattggggcctttcacgagatggaagagagttttccatcaaaaggtgacatattccttctatgtgctgccacttcgaaagcagcatctgctagatctaagactattgtatcttctcccatcaggtgcccttggcagtgtatgactgcactatcctggggaagcaggaccatatctaacaagtccaagatctccttcgattgtttgatagatgtctctaaggtggtcagtaatcttgcctccttccagaaggcagcatgattatgcagcatccagtacgcatatttgggacttgtctaagtatttactcattttccttttctaagggtcaaagccctgtttaggataataaaatctgcaagttcagcaccagtttagcttggacaaggttaggctcaagagtctcaaatttggttaccactatatgtcatcttttaaaaattctattcttacaattgaacttccatcagtaaaaaaaattggacattcgtatttttcaagggttggtttctaagagcaggtgtcacactaaaggttttttagcaaggtctcataacatgagtgttcaagatatgctccatcaggtaaggtttgagagaggggcaggtctttagtgtccctttaggcccttctaatgggagaacctgatagcttgtcatctggctgactgatggccatcactgtcccttggagctaagtattcttagctccaactgtcatggggaacatatgcagcttcatcagagttaatctgcctcaggaaagagaagtctgaggaatgcattgcttacaggtattccatccccttccttaaccatgaatatagcttcttgctaaggtatccactggaaggatgtctactattatttgggttagaattcttggagaaatccccttattttcaattatacaaagggtaactcagggttgagtcagtagccagaaaaggaggggcccatgtaattgcctatttgaatccctggaaggaggaacaggcctatagttcctataccagagaggaccagggacatttctgagttgctctaagaagtcagttagatgggttacccatttctgtaaatccccagttgtttgacagttttaggaacaggataagttagaataggctgcatttgctaggaattcagcctacagttttcctctctctgtgtcattcctaaatattgaactggagactgacatagttggcccttttcctgagagactttatacattcccatttagactatcttatctgtatgtcactttatattgtttgcattcctccctgagacccatgtagggactgagaggggatcttggacttgattccttttaataccatgactttccagaattggattccacagctgctgtttttaggtgtccttgtcccagtcccagtcccagtcccaagaatggtctttagctgtactcctggttttcagcagaagtagcaaatatcaaatagagagaaacattaggtacatagcaaactttcctcagttctatatttatgaccttccccagaaggaaaatccctgtttccactattagaatagggctactgctttctgtatggataagcataaaattatttgttttactacaaacatctttttttttttgtcatgagataagcaacagtagcttttttttttttttttaagatttttcattataagtaaatacactgtagctgtcttcaaacgtaccagaaaggggcatcagatctcactatgggtggttgtaagccaccatgtggctgctggaatttgaacttcggaccttcctaagagcagttagtgctcttaccgactgagccatctcaccagctccagcaacagtagcttttacttgagatcatttatcctctcgctgttcttaaaggcaccatgcctttattcttgggctgtttagttgtcctccttcctcatcatagtcagggggtcagcctgacccaggataaggcctaggaagacataatgagataaatatgcccaaagaagggtcaaatttcatctccaagtcgggcggtggtggtgcatgcctttaatcccagcacttgggaggcggaggcaggcggatttctgagttcgaggccagcctggtctacagagtgagttccaggacagccagggctacacagagaaaccctgtcttgaaaaaccaaaagaaaagaaaagaaaagaaatttaaatctcatctccagaattaactctcaatgagcttaaccagcccatgacaattcacaccaatattgttcatgcccaaaatggcatttacttctctatacaactgaatccattgttttatactggatagcattctcactgttcagccctgtgacaactgtccagactcaaaggacttgtcatcatcattgtcgtcgtcgtcttcttcttcgatttatttattaattatgtataattaattctgcctccatgtacacctgctcaccagaaaagggcaccagatcccattatagatggttatgagccaccatatggttgctgggatttgaactcaggacctctggaagaccagagaatgctcttaacctctgagccatctctccagcccggacttgtcttctttgacctagaactgtccaaataaattttatctgctggatcatacgtcaggaatggggacagagagcatcttttttccttttagggtgctgcttcatcttaatcggttactctatgatctctttaacctttataaggccatgggttgatgggtttctacacccacgattggaaggatcaagctgacagaggtatatctgtctgcatctgtgtctgacctgagatccacactactaagtcttggtgtgcccaattgtctaaaaccctgcatccacaatcactttgtgtgtgtctgcaaatggatgaagacaacctaaggaaatgtagtaagcatcctctctcctataaagcaatctagaagggctattttccccttgcaaaatgtagtctttttagtacatcaggaggaggctaggaggctttgactcagtcctttggagactcctgagatagaaatggaacagtgatagggaagtatccttggtctttaaagaaaacacttgaggtttttttttttttctccattctgattgatgtaaggtggaatctacgggtggttttgatttgcatttccccaggctatgtcaattgcacaatgcattaatcctagaaaatactataccgccatctagtggtcacctggttcagaataaaggaaccaacacagcttcagactatatctccttaaactcctaggtcacaagcttttcccagggctatgcctaatctgaaaagtgaagcaccattggaagaaagaatgtccctctctcacctgtgagggaaggccagcctccattcaaggacttggtcaaacatgaaaaagataaaatgcccttaactttgttcctggactatgaggagcttagtgagtcaagaaacctttatctctttgaggactggtgaggccacaggaaaagctcttgtattcactacttctgtggataagccttcattgtatctgggatactgtcagtgtatctgggaccacaattacattccttattgacatgggagagactattttttcctggatgatcttctcgtatttgactacccagtctctaggcatccttactgttactaatggcaagccctagcaagcttacttaacattgatcttaagctgtatgataaacaccatctttccacttattcctttctgagcctacctttgtcctccatcttactgttctattgttctgcagtgacaccatgacaaggtaacctctaagagaaaacatttaattggggctgccttacagttttagagggctagttcacgatcatcctgggaagcggacagatatggcagtggaacagtagctgagagctttataccctgattatcaggaagtgggtaaaagagactgagactggtgtactgtgggattctgagacctcaaagcccaccttcaattatgtacctctttcaataaggtcacacctactccaggaacagacctcctaatcctttaaaaacagttctattaataactaaggaccaaacattcaaacatacagacctatgggacattctcaggtaatatttatccttctcaggtctctgatggggttgaatatagttatagtctcacatataaattatgttgtttaggatttaagaaaatggtttaaggtctaaaaagatgtttgtagtttgatatgttaaagttatgatagaaaatgatttaggtatagaactttgaactcaccaagatagaataggtagtagagtactttctccaaaggtgcaaaatacaaaggactggatatgtgaatataattcttatctgagggttctcataatcgttcttttttatagtttattgatattagaaaaaaagctatttattggactaaaagggggagatgtcaggatgacatttttgtatactgtatggaggtgtatatttgttccttcctcacctgcctaagacattctctgattgacttaacaaagatctgaagccaggagctgaggctaaggcctaaactttcataaataaatatataagtatctgtgtcattatttgaaagctagtgggtcagcgacagtctagcaatacattcatccatatcatatctggaggacaacattttacagcatttctctcaatcctttggctcttttattccatccccatcttccatgttcccagtgcctcggtgaagagtgttctatgaatgagcatttacagtcgcatattttcagtgttttgaacagttataggtctcagcattagtcattacaaactgaaataagaagcttctctgattgaggttgagagctgcaccaatctatggatataagcatttagaaggcagtttaatagcatgagaatttagaaaacaacattagtagattctcccttcgggtctatgtcttccctagccatgggttttaatcatatttacaatactagacctacagagacagcttccaatcaaatcaagagagccgctggttaccctcataaacagttatgccactattgcaccaatgcgcacattttctagggcatacctcataagcagtgccataggctgaagaacaaagaacaaaatatacgagctttgaggggggcactttagatctaagctgtagtagtctctatgtattatatacatatgaaaacagagaaattatttaaactgaatttactatcaagatggaaactggaagtaaagatgtagaaatttttcatcatgtccatggaaagaatcaagcatgtgttgagagggcaaaaccagggtcatgatcaaaggatctcttggtaaggagatcagaatgaataagaggatgttaggtgctattcactataacagtgaagggtgccacacacttcacaggtccagagtcccagggccttgaaaaaatgttttaaaaggaaagtcctagaccactagaaagtagcatggaggcagactactctgatgtttttgacttactgcctaaggctactttatgtctctattcaagcacattgaatagtagtctttggctattctattattctatctgtggttttaaaaggccagagggcagctaaaactattactccagaaggcatggatcataaatcttgacagcatccaaatagtttttttttttttttaagatttatttatttatgcatgtgagtacactacagctgtcttcagacacaccagaagagggcatcagatctcattacagatggttgtgagacaccatgtggttgctgggaattgaactcaggacctctggaagagcaatcagtgctcttaactgctgagccatctctccagcccccacatccacataggcaaacaggacacataagctgtagaggtactgctactttcatctagatttctaagaatgtcttagaagcacacaggaatcaggtagaaaatgctagatgagtgagactactctgggaatgagaactcccagaagaacaatccaagccctgtattaaggccactatataatgtctacctaaagaactaaaggtcatggagataggtccatctacaagaaaccagaacttcagagtctctgtgtgctgaaacaattatgggcatgatatccccaaatctgtgagacacatggcataggctcttcctagaagtttgggaatctaattccattctcatatgtctaaaaggaaggcattgaagcaaagaagattgctttcaagcctgaagatttaatactatctagtctgctgggcattgaactttccagtgacctgttattcttatgttattcctgttgttccttcttgaagaactgaagctgagctacacaacgatgtcagtcactcattctgtgtagcagagaaattagcctctcacaccaggctaggacaagtatcagctcttttctgactagataaagcattaaaaaatagagtttaaaaagaaaataatgcttgattttaaactatgttgctgcccctaattctccatcttaagcagctctaaggaggctacaagaggaagaccaaatctcataataggtattatgatgtcagacattctataacctctgaactctgcttctagatgactagagctgctgttgccttgggatttccacaacacacctcttgccagttgagtcgaaatgaaggctctactttggctttactgtgttttgctttttgtttgctactgctgggctggtaagtcatagatacctggacatctttatgtatcattctttcccttttatgtccaaagactattctgttctttttatccctattttacttatccctttctgaattagttcagccttcttcaccacgtcttctcattcccttctccgtctgctacgtttatagatccatttcccttccttttacttccttctcctctctcccatgactttctgcccaccttttaaatttctctgcatcagagaaatttgtctatctttcctcacacaaactgtattttcatttagtttaaatgctcagaggaaaaagatatagcatcatgttgtcatgatagaaatagcacattcatatttactcacatagaatatcaatcacacatgcaaaagaagttaggccacattgaatatgcaacagaaactttctagctgaatttgagtatattaagtaaacactcagaaagatcttcagtagtgaaactgtctttaacgttatgttcaacatctctattcctatcatacccccttttcagtgccccaaatgtcaagactgagtgtgagttcaagctcagtgactggaaatctaccaccaacgaatagctacattgatataccatggctggcatctatgcctgataattgccagggtactatcctgactacaaggctgattctttcaacagccaactgtctgaagaaatcgtgagtatggaggaggagaaagaatgattttgggtcttcctggatatggttaagtgaattttccttttcaggactcctgctagtgaattcagagaaactggagaagattctggtctacagagtgagttccaggacagccagggctatacagagagaaaacctgtctcaaacaaaccaaaacaaacaaaaaaaccccacaaacaaacaaacaaaaaagaatcactttctggtactcaaatcatgtaatgggctttttactattatgtagccaacatcttttctgtcttctcacacttaatttttccatttccttctccctcattcatttgaaaatcaattgaatatccatcattgtcatgctgaaaactaatttctgaggagtcagagataaatgaattagtggttccattttgtctgtaatcaagcctgatgacctgagtttgattcctagaaagagaatgaacacctgcaagttgttctgagtcctatgcagttgcttgtgtatcataagggtccgaaaatcgctggaggaagaccccagacttagatggtatgcaaaaacaaagaatgtttatactgtagaaacaaccagaatatgggggtcaaccattctctaaaatggtgacccaagacgaaggcacgtcggccttctgacagggaaccagggaactttctaggattaggtaatctcaaatttcattggtatgtgctggtgtgtctgtgtgtgtgacaggtggtcagtggtttgcattcctgtgtcatgaatgtttaaccatagaatgagatagggctgccctgagtaaatgcccatcctgagataagatatttccccatttttgtggtggttgtctccaggctgttctttggtaaggggttttatgaccttgtttttggattttatggtctattcctggagctggtgccttatggactttaagatttttttttttctttttggtttttcgagacagggtttctctgtgtagccttggctgtcctggaactcactctgtagaccaagctagccttgaactcagaaatcgcctgcctctgtctcccaagtgctgggattaaagtcatgtgccaccactgcccggcacaatctctgttcttgaagacatattagtcttttatcaaaaataaaggaagaccttttgtgtcaactgaagagattagagtttctcacaaatgtaacaaagcagaaatcttagttttaggactggcaatattactaaggatataaccagaatctgttcataattacataatcatgtagcaactcagttacaaaatcttgttcagacttttctctctaatattgtgtcattaattcctttgtcttcattccctatgaccattgctttaattcagatattcctgatgttgattctggaatactttcataacagttctttaggctgtcatcatctatattctttttgtcttttgagaactcttggaggagggaccaggaagaggggcaacatttggaatgtaaataactaatacaattaaaaataatattttagggggctggagaaatggcccagtagataagagattcttcttcctgaggtcctgagttcaattcccagcaaccacatggtggctcacaaccatctgtaatgggatctgatgccctcttctggtgtgcctgaggacagctgcagtgtactcgtatacataaaataaatacatctttaaaaatattttaattttttgaaaatttgcatacaatatattttgatcatatcaccccacctgctcccaggtctattcctatttccctacccatccaaatttatgtgctgtttctctctcttaagattcatgaagttcaaaattattcaactactcctgggtgtggggcctgccccttgacgtggccctggctgttctggaactctgtagaccaggctagcctcgaactcagaaatccacctgcctctgtcttccaagtgctaggattataggcatgtgacaccacttcccggcctaaaaataattttttttgtttgttttttgagacagggtttctctgtgtagtcttggctgtcctggaactcactctatagacaaggttggcttcaaactcagaaatccacctgcctctgcctcctaagtgctgggatcaaaggagtgggccaccactgcccggcttgaaaataatttttatacgatatattctgttcatggtttctcctcccatattctctctactatcccagtcatccaactccatgatttctttttctctctctctttagaatataaacagggaaaacaaaacaacagaacaaaagaaacaaagaaaaaggaaacacacacacacaccattaaaacaacaacaacaaattacaaactgtaatattcaagcagaagaccaatatgtaaaaaattgcttaagaaaagcaatgagagaccaaaaaaaaaaaatgtctacaaaaataccattgtggtttttgttggcttctactgctggtgaaactccattgaagaaaactatgttttcctttgcaagcagttatcaattgagtaacttcttagttagggatgagaggttgtgtcgactttcccctctcagcactgggactccatctggcttgaacttgtggaggccctatgtatgctgccacagtctctgtgtgtttctatgtttttagccctgttgtgtttggaagacactgttttctgggtgtgattcattgccgaatcatcccgcctttcctacatagttttctaagcgctgaggggagaggtttgatggatacatgccatttaagacgagtgcgaatcaaaggaagacatgaccactccaaggtaaggttgaggtttttattgtagacatgagggagatacagtcagaggcacctggaagagtccagaacaggcagagaaagtagactgaacacagccagttaaaggagagagggaaggagaatgagaggaagaaaaaggagcaaaggagggcaaaggctattgaaagtggacccaagagcgcacatggccaaaatgtcaggtttccccccctccaggttttttgttttttgtttttttaatagaaattagaatttgggagaagggaaggaaaagaccccaggtgtcaggctggcaagagaggcttagggtaggtggtaaggtgagaagatctgacaggagcaagagctaggcaccccaggtagccttttgttctgaggatctgacattccagcctttttgtcaatgataaaggcaacataatctctcataattgctttttagctgaaattagggaaattagctgttgtggctggaggaggggtggggtggggggggggtaggaggatggaagccatttgttttccctgcctagggcctggggggcagggagaggaggatggaagccatttgttttttctgcctagggcctggggtgggggcagggagaggaggatggaagccatttgttttttctgcctagggcctggggggcagggagaggaggttggaagccatttgttttgtctgcctaaagcctggtggggggcagggagaggaggatggaagccatttgttttttctgcctagggcctgggaggggggagggaagaggaggatggaagccatttgttttccctgcctaggtcctggggggcagggagaggaggatggaaaccatttgttttttctgcctagggcctgggaggggggagggaagaggaggatggaagccatttgttttccctgcctaaggcctgggggggggggcagggagaggaggatggaagccatttgttttttctccctagggcctgggaggggggaggggaggatggaagccatttgttttttctgccttaggcctggggtgggggcagggagaggaggatggaagccatttgttttgtctgcctaaggcctggtggggggcagggagaggaggatggaagccatttgttttttctgcctagggcctgggaggggggaggggaggatggaagccatttgttttttctgcctagggcctggggtgggggcagggagaggaggatggaagccatttgttttttctgcctagggcctgggaggggggagggaagaggaggatggaagacatttgttttccctgcctagagcctgggcagggggagggaagaggaggatggaagccatttgttttttctgcctagggcctgggaggggggagggaagaggaggatggaagccatttgttttttctccctagggcctgggaggggggggggaggatggaagccatttgttttttctgcctagggcctggggtgggggcagggagaggaggatggaagccatttgttttttctgcctagggcctgggaggggggagggaagaggaggatggaagccatttgttttttctgcctagggcctgggaggggggagggaagaggaggatggaagccatttgttttttctgcctagggcctgggaggggggagggaagaggaggatggaagccatttgttttttctgcctagggcctgggaggggggaggggaggatggaagccatttgttttccctgcctagggcctggggggcagggagaggaggatggaagccatttgtttttcctgcctagggcctgggggggggggaagaggaggatggaagccatttgtttttcctgcctaaggccttggggggggggcggctggaagaggaggatggaagccatttgtttttcctgctgcctaagtcctgtgggtccgcctggtgctagcctctttggagcagtctgggatgcaggttcctaagaaatatctgaaattgacacttaggaagtatctagtttcctcctgctttcagcaattccagggaatgtaggttttgattcagagcagtttgtagcttgcagttcattggaaatctgatgggacttgccaagtctagggaaacaaagatttaggtctagtttcttgaactcccaatttgaagcctgtcatggaatcagcccagcctttctcagttaaaactcttgggcttttcaggtcttagtataaaagtagcagagtgctgggcagtggtggtgcatgcttgtaatccaagcacttgggaggcagaggcaggtggatttctgagtttgaggccagcctggtctacaaagggagttccaggacagccaggagcacacagagaaaccctctcttgaacaccccccccaaaaaaagaaaaaagaaagaaagaaagaaagaaagaaagaaaacaaacacccccaaaagaaccaccccaaaacaaatcaaaacaaaaaaacaaacaaaaacaaaacaaaactaactaaataaaagcagagtgaaaaggaaagcaatctgaaatattcctcatttttcacatatcttaaattactttcttatacctttacaaccttcttttacacaatttaaattattttctgacaccctcacagcttttttaatgtttcacatcctcaggcctttacaacttgcaattacatacattaaattactttcttagatccccatggcttatataaacttcaaaccttttctttccacctatttgagacacaatttgctgatttttgagagcagtcattgcaaaagaaattattttttttaaaaattatttatttattatattatatgtaagtacgctgtagctgtcttcagacactccagaaaagggcatcagatctcgttacgggtggttgtgagccaccatgtggttgctgggatttgaactcaggacctttgaaagagcagtcagtgctcttacctgctgagccatctcaccagcccaacaaattcttttaaataaagaaatagtaaaaaagttacattgcaacttgatttgtgaatttacatatttttgtgtgaagtctcccagcaagataaaaatgtgtcttctttctcagcatgaaacctagtagctctagaaaaatgaggcttgattttacacatgaaatggttgaccaggcagctgccgcttgggggaggagctgagtgcctaccactgcaaaactgataaagctgtagttaaccatcaatatcatcagttctgacaaagatagattatagcaggaaaaaaattatccaaatgttttctgtatcacttgaaatgacagagacattccactacctggagagttaccctaggctcccagatgaaggtcttgactgttttgttgggcccaaaagttgttggtctatggctgttacacacaaaagcattacatttttggttgccaaacaagacatcattggctttcagctgccagactcagaatgtctgaaagattttcctgtggagggggaacttggggaaacttccccaagtgaggcagacagattaggacagtcaacctaacagtgtccacagtttgcacagggccctggcattgggtgggataaggaagagtttttccaagtggttagcattactgtaatctaggtggagtcatctgtgtttcactgacttctttggacaccttagggttgcttctgggagctagcatttttgcctattacaggaagcttttcataaacacttcaaataccatattcaacagatctctgaggagtttgaggaccatctattatgtattacttgttttcagttacttactttgaaaacatgtacagaaggctaaataaagctggggctggagacatggctcagcatttaagaagagcactgactgctcttccgaaggtcctgagttcaattcccagcaaccacatggtagctcatagccatctgtaatggaatctgacgccctcttctggagtgtctgaagacagctacagtgtacttacatataataaataaataaataaataaatattttaaaaagcttatgcttataaaatgaattagcatgattatgagcatagttctgagcacattaaagaatttgatcatgaagtgactgattactaatttgcatgtcttacatatatttaacagtttacaagttggtagcttttataagcttactgtttttatagttttatctttgttaaaaataagttgaagatttaattgaagatccttcagcatcaaaataaaactttataagtgtagtctacagagaaactgagaactttataaaacataaatatagcccacataaagactagaaaccttatgcttctgatccttttatagcatacccttatggactgtcacagacttttgtagtattcagattatcaaaatagttaaaagttaacaaagttagcaaagatgcagagggtagacatagatcttcaggtcagttgctgttaaactgagtaggtcttaggagtttatagatgttatttaacatacatttttatcaaacatacgttgttccttaaaaatttctagaagcctggtgttgaacagttagccaagatacaaatagttagacatatatctcttaagtcagtttttaagatttatttatctgtttatgagtgctttgtctgcatgtacacctgcatgccagaagagggcatcagatcccattacagatgattgtgagccaccatgtagttgctgggaattgaactccagacctctggaagagcagccagtgctcttaaccactgggccatctctccagccctctgttaatccgagtagatctttataactttaggaattgatcgtgcaaaaatccaaatccacattctaattcaaaatacttgaaagattttttattggatattttatttatttacatgtcaaatgtaatcccttttcccagtttcccccactccccagaaccccctatcccatcatccatccctctatcccatgcatcctctccctcctcactaccctggcattcccctgcactggggcattgagccttcacaggaccaagagcctctcctcccattgatgccctacaaggccatcctctgctgcatatgcatgcgactggagccatgggtccctccatgtgtactctttggttggtagtttagcctctgggatctctaggaaggggatctggttggttgatattgttgttcttcctatagtgttgcaagtcccttctgctccttcagtcctttctctaactcctccattggagaccccatgctcagtccaatggttggctgtgagcatctgcctctgtatttgtcaggctctggcagagtctctcaggagacagctatatcaggctcctgtcagcaagtacttcttggcatccacaatagtgtcttggtttggtgtctgtatatgggatggatccccaggtaggacagtctctgtggcctttccttcagtctctgctccacactttgtctcagtatttattgcctcccttgaatattttgttcccccttctaagaaggactgaaggccttctttggtcttccttcttcttgaacttcgtgcagtctgtgaattgcatcttgggtattcagagattttgggctaatatcccacttatcagtgagtgtataccatgtgtgttcttttctgattgggttaccccactcaggatgatattttctagtttcatccatttgcctaagaagttcatgaattccttgtttttaatagctgagtagaactccattgcataaatgtaccacattttctgaatctattcctctgttgagggacatctaggctctttccagcttctgactattataaataaggctgctatgaacatagtggaacatgtgttcttattaccagttggaacatcttctgggtatatgctcagcagaggtatcgctggatcttctggtaatactatgtccacttttctgaggaaccaccagactgatttccagaatggttgtaccaactttcaatcccaccaacaatgttcctctttctccacatcctcaccagcatctattgtcacctgagtttttgatcttagctattcttactggtgtgaggtggaatctcagggtcattttgatttgtatttccctgatgactaaggatgttgaacatttctttaggtgcttatgggccattcacgtttcctcagttgagaaatctgtgtagctctacatttttaatagggttatttggttctctggcgtctaacttcttgagttagttctttgtttatattggatattagccctctattggatgtaggattggtaaagatcttttcccaatctgtgaattgctgttttgtcctattgacagtgtcctttgtctcacaattttatgaggtcccatttgtcgattcttgatcttagagcataagcgactggtattctgttcagaaaaatttcccctgtgcccatgtgtttgaggctcttccccactttcttttctcttagatttagtgtatctggttttatgtggagttccttgatccacttagacttgagatttgtatagggagatgagaatgggtcaatttgcattgttctacatgttgactgctggttgaaccagtaccatccactagattgttttagcttctttgtcaaatatcaagtgaccataggtgtgtcggttcatttctgtatcttcaattctattccattgatctacctgtctgtcgctgtaccagtaccatgcagttttttttaagattttttttattgttacatgtaagtacactgtagctgtctccagacataccagaagagggcatcagatctcattatggatggttgtgagccaccatgtggttgctgggatttgaactcagggccttcggaagagcagtcagtactcttaactgctgagccatcttgccagcccaccatgcagtttttatcacaattgctgtgtagtacagcttgaggtcaatcatggtgattcccccagaggttcttttattgttgagaatagttttcactatcttgggtttttgttattccagatgaatttgcaaattgctctttcttgctatataaacattgagttggaattttgatggggattgcattgaatctctatattgttttcagcaagatagccatttttactatattaatgctaccaatacatgagcatgggagatctttccattttctgagatcttcttcgatttctttcttcagagacttaagttcttttttttttttttttttttttttttttttttttgtgggtacccttgcattggggaatagctgttcagaattgagacatcatcttggtggatttttcctttaatgagtattaagtgtctttgcctatttcttttgatagatttgtggttgaaagtttattttatttgatttttagaatggctaaatccagtttgtttgttgggtctgtttgcttggaaaacctttttacagttctttaatctgaagtaatgaactttgttgctgaggtgtgtttcttgtatgcagcagaatgatggatcctgtttgcatatccagtctgcaagcctgtgtctttttattggtgaattgagtccattgatgttgagaaacattaatgactagtgattgttagttcctgttattttgatgttaaaggtattagtgtatgtgtctgagttccttttatttttgttttgctgtaaggtgattaaatttttgcatgtgttttcttgagagacttaagttcttatcatacagatttttcacttgcttggttagagccacaccaaggtatattatattatttgtgactattgtgaagggtgctaaattccctaatttctttcttagcctgtttattctttgagtagagaaaggctactgatttgtttgagttaattttatatctagccacttggctgaagttctttatcaggtttaggagttctctggtggaatttttggggtcacttaagtatactatcatctgcaaatagtgatttttacttcttcctttccaatttgtattcctttgatccgttttgtctaattgctctggctaggacttcgagtactatattgaataggtagggagagagtgggcagccttgtttagtccctgattttagtgggattgcttcaagtttctctccatttagtttgatgttggctactggtttgctgtatattgcttttattatgtttaggtatgggccttgaattcctgatcttcccaagactttttttttaaaaagatttatttattattatatttaagtacactgtagctgtctttggatgcaccagaagagggcgtcagatctcattacaggtggttgtgagccaccatgtggttgctgggatttgaactcaggacctttggaagagcagttagtgctcttacccattgagccatctcaccagcccttcccaagactttttttttaaagatttatttatttattatatgcaagtacactgtagctgtcttcagacacaccagaagagggagtcagatcttgttacggatggttgtgagccaccatgtggttgctgggatttgaactctggacctttggaagagcagtcgggcgctcctacccactgagccatcgcaccagccccccttcccaagacttttatcatgaagggatgttgagagagagaggtgaggagagtgagagacaaagagagagcaaaggatggcaaagcaaagagaattaaaagtagagccaagagagtacatggccaaaatggccgatttttaataataggaatcagcgggctgggtggtggtggcgcacacctttaatcccagcacttgggaggcagaggcaggtggatttctgagtttgaggccagcctggtctacagagtgagttccaggacagccagggctacacagagaaaccctgtctcgaaaaaaaaccaaaaaaaaaaaaaaaaaaaaaaaaagaggaatcagaagctgggttaagggaagtgaagaccatggactgtaagatcttggaggctagtctgcacttgggtttgctgataggcaccgcagtgagccttttgtcctgaaattctttgtaacaaactgacatgtgccccaagatttcccacactctgtacattgtctcatatattagttcccatctcttgcaaaaggaagcttctctaatgatgactgagcaagacaccgatctgtgagtatagcagaatgttactaggagtcattttactgtcgtgtttcattagcagaacaataatactttgttttcccctagacccatggcctatccaatttcaggttattggctacctgaacagtattaagcatggattctatctcatggagtgggccttaaatccaaccaggtaatggttggttatttccacagcatttgggctactatttcatcagcaagctatgcagataggtcaccattgcagaacaaagggtttgtgtcagaattagtgtttaacctttctctggtggtggtagagtaccttctagtagcataacagtactcaataggagataaagctttcttaggtaacagctcaacttctctgtgttcaatgagaatatagagacaacatcagtttatggggagcaaccttagtaatagcctgagttctttaggtgatgtccatgagaggcctttgaccaacaatccaattatatgtaatctatttgtggcactggaagtttctcttggtggaaaagatggctagctggagcattgtctcccctattatttggtaactccatttacatttctttcatatttgcatatcttttaagaagtttctgcagtagtaggttaccatgacccctcaaatggcccattctcttcctatattctcttccttaacctctctttcctctccttccccatttaatcttcctgttccagcccccttccccatctatccataactatatatactgtttttccttccttgggagaacttcccatctactccggttgcttactctatacctgtccactgtagttatatgacttagaacatgcctaaaagctaacatccacatataagtgaatacatacaatatttgtctttctgggtctgagttacctcactaaagtgggtttttttttctagtttcaaccctttaccagtgaatttcatgacccttttttttaaaattaaagaaccgaataatattttattgtgtaaatgtgccattttcattattcactcagctgccgatggacatctaggctgtttacaattttttggctattataaatagagcagcaatgaacatggttgagctagtgtctctacagtaggatgaagtgtcctttaggtatatgctcaagagtgctttacctggatcttgaggtatatctattcccagttctctagtgagctgccacactaatttccagagtggctgttcaagtttttactcccaccaataatggaggagtgttcactttttcatatcatggtcagcatgatctgttatttgtgtttttgattttaacgatcctgacaggtataaaatggaacctcaaagtagttttgatttgtatttcttttttttaatatttatttatttattatatgtaagtacactgtagctgtcttcagacactccagaagatggcatcagatttcattacagatggttgtgagccaccatgtggttgctgggatttgaactcaggacctttggaagagcagttggctctcttaaccgatgagccatctcaccagtccccttgatttgtatttctttgattgctaaggatgttgaatatttgattaattgtttctcagtcattagagactcctgttgagaattctgtttacttatgtacccattttaattggcttatttggctgtttgatatctaggtttttaagttctttattattttagatcttaactctcaatcagatatgtaattggtaaaaattgtttccgattctgaaggcttccactttttctcaatgacagtgttctttgactaacttttcagtttttttttaaaagatttatttatttatttattatatgtaagtacactgtagctgtcttcagacactccagaagagggcgtcagatttcattacggatggttgtgagccaccatgtggttgctgggatttgaactcgggaccttcggaaaagcagtcggcgctcttaaccactgagccatcttgccagcccaacttttcagttttatgagtgcccatttttcaattgttgatcttagtgtctgtgtgattggtgcttgtgagttcaaggctattccctaccttatcttctatcaaattcagggtatctggacttatgttgaggtccttgatccatttagagttgtgctttgtattattctatatctggccatccagtgtgatcatcataatttgtttaagattctgtattctttctttatctaggcttctttatttattgcttctttataaaaagaaatcaggtgttgataggtgtgtggatttatgtctgtgccttcaatttaactgatcaacatgtctattttcatgacagtaccatgctatttttatcactgtagctctatagtacaatttgaggacaggaacagtgacctttcgagcatttcttttattatccaggactgttttagctgttctgggtttttttgtgtttccaaatgaagctgagaattatccttgcaagatctgtgaagaattgtgttggagctttgatggaaagtacattgaatttatacattgcttttggtaagatgaccattttcactatattaatcctacctatgcatgagcgtgggaaatctttccatcttctgatatcttctctcatttatttcttcaatgtcttttttttttttttttttttttttttttttggtttttcgagacagggtttctctgtatagccctggctgtcctggaactcactttgtagaccaggctggcctcgaactcagaaatccgcctgcctctgcctcccgagtgctgggattaaaggcgtgcgccaccaacgcccggctctcttcaatgtcttaaagtttttattatacaagtctttcacttgcttggttagaattatctcaaattatttttcttttgaagctattgtgaaaggcattgtttccctggtttccttctcaatctctctgccatttgtatataggaaggctactgatttttttttttttttcagagaccgggtttctctgtgtagccctggctgccctgaaactcactctgtagagcaggctggccttgaactcagaaatccacctgcctctgcctcccaagtgctgggattaaaggtgtgcaccaccacagcccagcaggctactggtttttatttttagatttgtatcctgatactttgctgaaagtgtttatcagctgtagaagtttttcttcatggagtttggggtctttagtatgtaaaatagtatcatcagcaaataaagatactttgacttcatcctttccaatttgtatcctcttgatctccttcagaatctttctctagctaagattccaagtagtatattagatatatagagagtggacagctttgtcatgtttctgattttagtgggaatgctttgagtttctttccatttaatttgacgttgactataggcttgctgtaaattgtctttgttatgtttatgtgtgtatcctttgtaaccctagtctttccaggatttttaccatgaaggcatgttgaattttgtcaaaggccttttctgcttttaatgaaatgaccatgtgtttttttgtgtttcagcctgtttatgtggtggattacatttatcaatttatgtatgttaagccatctctagatatctctgatgaggctgacttagtcataagggaaattaagttctctttcatattgaatctttatgtggtttgggtatcagggtagctgtgctctcataaaagaaataggcaatgttccttatgtttctatattgctgaataatttgagtagatttgatgttaattcttctggccctgggatttttttttttttttggtttggttgggaaactttaagttactgcttctatttcactgggagttttgatatttatccttttttttttcaggtttcccggtatggtagaactgtacgtgtgctcctgattctctaggttttctcactttcattttgtctctagtttaacgaatctatatctcttctctcctttttattaatttgtttaagagtttatcaatcttattgatttttctgaaagaactccacatttcgttggctctttgtattattcttttttgattgattgattccagccctatatttggttgtttatttcttttttggtctttaccttttgggcatgttattttcttttaacattttagatatatgattaatttactaatatgagatctttaatttttttatgtagtcacttagtgctatgaactactactgtcttcattgtgtccaggtttggacatgttctatttccattctcattcagctataaaacctttttaatttttttcttgatatctgccttgaaatttattttattcagtagtgatttgtgcagtttctatgagtttgtatacttgatgttgtttctgttattgatattaatctttaatacgtggtgatcagataggatgcattgtgccatgacaattttaaatctgttgagacttgctttgttccctagtgtgtggtccattttggagaaagttctatgggctgctgacaagaaggtattttattttgtgtttgggtgaaatgttctataagtatgttaagtcttattagtatgttaggtctatttggtttataatgtcagctccagcattttgtttgtttgtttagtttttgtctggatgaactatctatttgtgaaagtgggctattgaagtcatccaccattcttttttttttttttttaaatgatttatttatttactttaatgagtccactgtagctgtctcccgagatgccagcagagggcatcagatcctattacagatggttgtgagccaccttgtggttgctgggatttgaactcatgacctctggaagagcagtcagtgctcttaactactgagccatctctccagccccatccaatattcttgtgtgagggtcaatatgtgattttaattgaaacaatgtttctttataaaaacttgggttgcccttgtgcttggtgcataaatgtttagaattacaatattcttttgatggaatttgtcccttggtaagaatgtcgtgtcctttctcatctcttctgattagttttgttttgaagtctgttttattagatttaaaaataacgacacatgcttgcttcttgtttcatttatcctaaagtgatttctatcctagatattatggtgtgtttctttgatgcagcagaaggatcctattttctaatcagttctgttagtctgtgtgtttctattggggaactgagtattgatgttgagagttatcaataagcattgtttattgattcctgttattttgttgttatggtgtatgtcccccccccctttaatttactgttctgggattatttattccttggattttcttggtatggttaacctcttcagattgaagttttccttctagtacattctgtagggctgtatttgtagacagatactactcaaatttggttttattatggaatgcttttctttctccatttattatgattgatagtttttctgggtatagtaatctaggctgaaatctgtgttctcaaaaagtttgtagaacatatttttcagacccttttagcttttagattgagaagttgagtgttattctaatgggcctacctttataagttacttggtctttttctctaccagcttcaaacattctttatttttctacacatttagtgttttgattattgtgtgtcccgaggagtttcatctcacagcctatctatctggtattatgtatatttatctttttaaatctttttattagttctttgtgacgttcacatcatacacctcagtcccactcatcatcttctccttttatactcaccctccacccttgccacccccctcaagagattaaaaataatctcattgtggaagctgtaatttgtcacagtgtgccccacagtataccccgtttgtccacacttctttacttgtagatgttcattgcaatgagtcattgggctggtccgagttctctggcttctgctacactatcagtacagaatcctctcaggaactcctctcagatatcctgttgttgccccttgtcatggagaccctgtggttttggatctatagaatcaggcccttcatgcactccagcagttcatcaacagggtacattttgggggtggtccaattcataattcctggatctgggtctgagcggtatcagagccagctttcctacattcacaacctagggttagctcaccagcaacctccccccacttcccgacctctaccccagaaacctgggtcagctctgccctgttgcccaggcaaggtgcagggcttgctcttagagagttgctgcaggtgaggtacatgactctcatgactgtggggtcagttttcccacctaccatgggtgtgaagggacaatctggactacctcacagcagacaagttcagctctcctaagctcacacccttagggctagctcacctgcaacccccatatccagggccaggtccactgtgcttcccatgcaaggtgtagggccttgagtgctattgcaggtgaggggtaggatcagctctcctgccctcatgaccccagggccagctctgccacctgttgtaggtggcaaaggatgagggtgggggaaggcatctttttcccttacccatgctgctgaagtgcagacaattgcatagccagatgtcccattctcagacctttgagtcacctcattcacgccctcattagcaaggtcagctctactgtggtgcccaggtgaggtccagagcctattctccgaatgctgcagcaggggaggggcagggccagctctcctctgctcccaagctccctaggggatggctcacctacagccttcatatacatggccagctctactgtgctgtgtgcaggccttgctctctcaatggctgtagtaggtgaggggcagggccagctttcctgctctgatgaccctggggctagttctcctgctttcaataggtggcaaggcgcaaggggggcatttctccactgcttatgtcactgaactgcagaaaagtactgcaactggctaggggtggggtcagctctttcctctcatgccctcagggccagatcttcaacaatgcccagatgaggggtgaggctctcagatatcaacatatctacttgtggcagcccagactagggacatccccctggcctttggtggtaacagacccctgctccagccccttgcaggaattattgtagtagggtctaggcatctgttattggggtgattgaggtgattctagttttgctatgtggccttgtttttgttaggtgggctccccctcccccaccccgttcttaattcagtggctctctggtctggaagaaagtattgggcttcttgacggtgaagcatggcttgggctggcattgcaacacgtggtggtacaatgggaatttgatcttggagttgtggaactgctttgacagcctgccaggggcacctgccagctgcaaatctcttctaccttcataatctcaattgagtgtgcacagatatcaggcagctgtgttgcagtagcactgtgtgactgtgccagcagtggtcaggtcccagtactcttgctgtatgccactgaggggatcatagcacagccagatgccaaagttcttcacaggcaagacaacatgggtgacttctcaaacacctgcccacagtacacattctccctggatgacttcttcatcctcttcagctgtgacatgaagtaccagaagcaggacttggcaaccacatggttgagtgcaaagataaagatgcatattcggtacagtggcaatatatggcactttggggttgtcaagcagccctccacactcccaaagtgtgcctgatgcctttgtggcagcgtcctcatttgctgccactcacaataggcctcttgtgccttcttaatcttagaaaaagtgtagtggctgtgggtttcatggcagagagtgcttcttcatgtcggttggtggtagaaaggagtagaggtgggctaagaggaaatgcttaaagaggcttcagcaaagagctaaaaggatcctgtttaaactgagaggcagggtccctgggaattgtatgtgtggtgggaagatgggattttgcaatcaagttgcagaaggacaaagaataatctggagaagcaggggtgaatggactagggggactgtgggtctgaactaggagctggagcctgtagtcaatatagttgaggtgggagaagagacactagtaagcaagtctgttaccaggctcagaataagaatggagagatcctaatggaggacaagaatgtcagagtgacgaacatacttgagtccctgacagttgcaggcactgcggagccctgggtagaaaatattttgaggtattggtgtggggatacaaggagggggtcagtggagagggaccaccagaaggaggaaatctgtgctcacaacaacgtttggtggagtcccccagggactagagataggacgggaggacagagccctgctagcatgtagctatagggctggggatgagatgggaggacagaaaggagggtaaaaatcatccacctgaatccaggaccagagtgtccacaacgggaccctggtaaacttctttctatgtatccttggctggcagaaggccgtgtttaaagcaagttctgtggagtcctcagaaattgaacgtagggtgggaggagaggaacatgaaaacagtctgttacagggttggggataagactggtgagactgttgagagtggaggatgcctacctgaggtccagactgttctggccactggggatccaaggtggagaatctgggctttcttttcttttcttttcttttcttttcttctcttctctttttctttttctttttctttttctttttctttttctttttctttttctttttctttttctttttctttttctttttctttttctttttctttttctttttttctttttctttttctttttttttccgaggcagggtttctctgtgtagccctgactgtcctggaactcactctgtagaccaggctgtcctcgaactcagaaatcggcctgcctctgcagtgctggcattaaaggtgtgcgccaccactacctggctgggtttattcttcaatttgagaatgctatatctgaaatggagtttggataggctgaccttctcttttcaatttatggaattcattaagatccaagtatcaaaagcaagtttttcaggctggcgagatggctcagcaggtaagaagagcactgactgctcttctgaaggtcctgagttcaaatctcagcaaccacatggtggctcacaaccgcccataatgcgatctggcgccctcttctggtgtgtctgaagacagttacactgtaactgtacttacatgtaacaataaataaatctttttaaaaaaagtataagtttttgagaatcaaatagttggtggtgaagcagtagaactataaaggaaccaaaggccaatagaatatagtgccttatataggcactgtgtggcctggaattaagataagattatgatgtcaaataaatgaaaaactgggttattttataactttgaatttgacctatgctgccttttataagatattatatggattatcctttattatcatcaattagattgttgcacattctttttcaaccctaggaaaccgttatacctggacatttcaggagtaaattacccagaaagcacttcacatggtcaaagaatctgcctccaccccaagtttaatctcaacgatgaaaatgatccaatgaaagcagatattggcttggttattcttgaaaagcctatcgatggggatgaaataccactatcccagtcccctagtacatccctgaagagctgttctaagtgccaatacaagagctgttatgtgtatgaatatcagagtaagtaaaaggagtcaagttacactattttgtgatattggctctagggatatgattcattttctaaagatattaagtctctaaagaggggaaaataatttagaaaatgtagtaggggtcattactgatgtccaccaatctattcaaaataatctgaagcataagaaaggaatggactatgcctgaatttaagtctcaactcttgttacagaactctttctatattcaggtattttaactatttcttgttgctgtaatgaaagatctaacagagatgatttgagacagaatagatttattttggctcatggtttcagaaggttccatatttgccttcttgttcctacgtactggggagaacactattgcaattgaagcatgtggtagaggctgcttttcacttcttggtggtcaggatagtagacaaaagggaggagtacaggaaagtgcaagagtaagatattggcctaagagtgtgtccccagttagctacttcttcaagtatggtatactttatacttttaagaatatatcaatgctactatcatattcatcaaatgattaattcattgttttgttcagagtggtcatatgctagatgtttggaaatgctataagatatgtccaaaggtgggctcaggtatcccaaggtgtttcttaatccgattaagtttataatcacgactaaccatcatgttgggtagtgatggcacatgccttttagttccaacactcaggagtcagagacaggtggagctatgtgagtttggggccagtctggtgtacaaagcatgttcaaggacagccaggaaaccctgtgttgacaaaacaaaacgaaacaaagtaaaacagaagactaaccataacaacagtttaaggaaggtgtgagtggttcagaaagtagaaggtaaggagatatgcaaagagagaagagaaatgaaggaggaaaggaaaggaagggaagaaagggaaagatgactgttttgggaacattatgtgattgaattgagagtggtgacaaaccgaagtctgagatccagtgctttgcatctcagcatcatcctttatgtatccttttaggtagcaagaaacttggaaccagcagagtaaagaagatagatgtgcagctgctagatttctcaatgtgctacccccaacattccagtttagagaaggccgtgggcttgtgtattcagagtcaaccacgggaagactgctgggtaatcatataccagaacaatattaggaacaagcaggaaatgaaaaaagtacaattatataaatatgcaaggaaatgttagataacaggacataaggaagttggtgtcaggcaaatatgtgaatctggaagtttcattcaatatttgagtggcatagagtttgcacaaggaaggctttagaaacaaatgagaaatacaaaaaagaatcaatggacacatacattttatctttctgtttttaattttattatagcctctctgtaggtactatactgaacatgtatggctcaaacttagctgggggaggtttagaagacacagatacaactcatcccacctattcatgcagaaaggctgtagaaaataaagccctatgcaagaacatttttaggtactaatataccttggacaatttaaaattgcacacacaaataatattgaaagacttcaaggaaagcattaatctgaagtgtggaaatcctgactgaattacttcaggatatgaccagcctttcgtgctggtaatgatgagaaatacttaagtaaacaagaatgaatgaaaaactgttcaaaaccctgtttcaaattgagatgagggaataacacatgcaaagctatagagttagtagctaggtgtcttagaggatcatcgcaaggaatgagatggataccagtgaagataggacaggctattttctcatgagtttatatgtatttgagatgtgatcaataataagtaaataataacagaagtgatattaactattttgtggataataaatagagcagggctgattataaccttgtgttccaactgcaatctgaaagaattggactacaaagacagcgttagcgtaaaatacttgcaatgcaagatagaagagtttttgtctatataaccccattcaaaacaactaggtaatcagaaaaggcatctgtttaaaaaaattaataaaagtgtttgaatggaattatgggagaactgatgaagcaagtaatttaataccaaagcagtgttacaagtatagtgtattgaaaaggccaatacagagattttcgatgtgtaaatatgtctagaatatttccataacagagaagacaagccaggtggctatagtatcttagtcaacagcagcagtagatagcatcaaggtagtaataagggtttctaagaccttatatgctattatgacaactacgcttttgacattgttagaacttgaaagcactcattggagaatttttaagcagaaagatgtatttattggtctttcttagattttaagaggataagatagaatgccgtgttaagatcagatgtgagaacaagaagtatgccttttcataaagacactatatttcctaacaatagaagcattgctagataagaaaattattaattattaaaataatttttgggaaattattgaaagtatcagaagcattatttgttgagagactggttaacatagtgtggaggagagagaggcacaaataatgatttcaagttttttttaaattttcattttttattcagttcatatcccaattacagacccctacctcctctcatcccaggtccacccttgtaactccctcccctcattgcccatcccattctcctcagaggaggggagcatcccttgggaatcacccctcaaggtttttttaaacttgaacttttggaggggtcttgtgactttcactaggaaaataaagcaaaagtaagattttgtatgaagaagatcagttgttcttttggggtttaacactgtttgatataactcttagaaatccaagttcagtgttgataaagtggctgattgtaagagtttgaaaattaattagtactgacatattctattttttaaatttttattgaatagtttctttatttacatttcaaatgttatcccctttctctgcttctatgagggtgttcccccagccagccacccacccctgcctccccaccctggcattcccctacactgggacatccagccttcacaggaccaaggtcctctcctctcactgatgcccaacaaggccaccctctgctacatgtgtagctggagccatgggtcccttcatgtgtactcctgggttggtggcttagtctctgggagctctgagggtactggttggttcatattgttgttcctcctatggggctgcaaacatcttcagctccttcagtcctttctctagctcctccatttgggaccctgtgctcagtccaatggttggctgagagcatccgcctctgtacttttcaggctctggcagagcctctcaggagataggtatatcaggctcctgtcagcaagcacttcttggcatcatcaatagtgtttgggtttagtgacagtatttgggatgagtccccaggtggggcagtctctagatggcctttccttcagtctctgctccacactttggtactgacacattctatattctctcatatgtttcaactatatgtgcctacatcttacattattaatttttgggagctgcttgataatgaatattatttgaatttttccctccccctcacatagtatatggactgtatacatagtaaactgtataagtgacatatatttcttggtttccttattcaggtacagagagccagtcctgttctatgtctcctaatgaaccactgggaactagtgggcctcatacataagacttcaaagatatgtcaaaatcccgcagtcatcattagaacagctccttactttacctggataaaacaattcatcaaggtatctaagaagctactaaatcctactcgctccttacactgtagaacattgtatgaaaatgagtatgttccccaaatcagacatagccataattatttcacaactctggcctctagcgattatctcttgaggattttacaaggaaacgtaggtgtttctccacaaactacacataccaacaatgtaccaacaatctttaattttagtgatctaaattatcttgctgatagttatagattgttccttgataaaaaccagaccccacaacctgtccagcaattgcctgttgctggacttccaggaaaatttggacagaatttaattcagtatcagccaaatactcctccacataatataggtaatttaagtaaatctccactatctcaggttatttctaacacaactatatcatataattcttctaaggctgatggtgataattccttgggttttgcagcaaacaatactgatgagtcttttgataaaatcatggcagatataattaaacaatcaagcccaacagaagatgatgaagaggaacctgaaaatctctatgaggatagtatggctgataattattggacagaaaatgttgctgatttagaaaaataccagaatcttttgaggaccatgtcagaaaaacctcagaatcaatatacaactaaggccagcttaccaccaaatttatatttacctgaaggagaggtaccctggggactctctacttcaggtgcaactgttaaaaaaacagacctgcccatgaaatgtctacaaccaaatgaaacatctaatatgtctccttttgaaagtagagggattcccaaaccaagtggtgtaattaagctctggaattccccttttggctacaatgttgtaagttctcaagatcaagcagttactgattcagtaagagctcagaattatcctgtaactgatgccagtcaactccagattctaccagtggacagcattggtatgccctcgactcctaaatttacctatgaatctttacctactgattttgaggctaaaacccatcaaaatccaaattagcacgatatagtaccaccacaaggccagtcttcatcatttaaggccatttcacaacctgtagttgaaattaaaccccaactgaaagctgaatctgagagaactagacacccagacttgaaatgtcatttgtccttatggaaaattatataaacacttatgtcttttcaaaaaaattaaaataaaaacaaattgaaaagcaaattattaattagatcttgttccctattttgtaagttttaagaggattttttttttgaggcttaagaaccattttattagagtttaaaagaaacatagcagggcaggcaacctgaaaatccaggccgattccagaagaaatatggagaaagccacgccttcttgggttagatatgaagtttagtaatggaggctcctaagcagcctcatggcagaagcagaagagggggatacaaataaagcaagagagcccagtacatcaatggggggtggggagggagcccagacattggcaagtattcaaaagatggggaaaagaaacagatgcgttttggaacttaggactccaggaagtgagcagaccacaaggtggaggccccacaggtgactagagccaagacagagtttcggccaaggaaaatacattctctcattaaggagataattgttcctcccatctctttagtatattttaggtcaatcagtgctcctgaggtatggtcctttggccaaataattgacagatctagctggagtaacactcttttcttctttcaatcccttgggtagattctctggggagtgagcaggaaaacgggcagggtagtgctgcttaagccccactcagtcgtcctccagcaggttgatcttggtggggtcaaaatagttggactccatgatggggaggccactggcctcttggtgtttcaccagcatcgcagcttcccggcgggcccactcgatcatcttatagtttggcacataagccacaaaggtagtgccaaggaccagggcgatggaaaaaccaaagaagaagactgcgtgcatattcaaggcatccaccttcgggtagtcgtcgtaaccatgtggaagtctgggttcttcaagtacacgttttcgtccttgggtcctccatccactgcacggtcggttcttcctgctccttttgggccgcagcggactgggcgaccacagccctggaggagctggatttccagcaaagtggggcagcctggagccgtcgaattgcggaaaggctgcgagcgcacaaacttaaccgccaggccgccatgacagctgcagtggtggggcaagaggattctttttacaggtggatcaatttaatggtttgaaagcttttcatgttgaaaattattccaagttaattgaagaatcacacagtttaaaactaccaccaggagcttgagagatggctcagcagttaagagctcttggcagctcttccagaggttccaagttcaattctcagccaccacatggtgactcataacagtctgtaatgagatctgatgccctcttctggcatgcagctgtacatgcagatagagcacttcacatacataaaaaaaatcttaaaaaattcataaaaaagttagctgtgctacatttttcctaagttgtaaaatttttgaaaaactgttgttcaacataatcagaatattaacatagatacaactcatccgttttatttataatttttatgtttgtactcatttgtatatatattttgcaattttcaatgcataagactcatgtatacttcttcacagtcatgagatataatagttctattgccataaagcttcctcatgttaccattttatagtcacatctactgctttctcacaagaatcttgccactaatctttaataggcattaatatgtcctccatcacaaaaatttgatcattttgacaatattatgattggaatcatattgtataagatattttgtaattggctttttattcagcataacctccttagtatttaagttaatttgtgtgccaaaatatgtaccagtaattattttaatcactttgttatgttagaagatatgggcatatcactgtttctctatccactcacacattgaaagctatctggattagtttttttttattattgcaactggtttatgtggacattaatatgcagtatttgtgtgaatacacaacttattttttctaggatcaagcttcctggttaactcgtcttaggttttttttttttttcctcctgtttatatcataaaacattatgacaagagcaactttaagggagatgcgtttgttttagcacatggttcagattatagttcattttggtgaggaaattccaactgcaggagcttgaaggaactgggcattcatatctacaatcaggaaaaatgcatgctagtgttcagctcgtcttctctattgtatacagtccagaatctcttgccaaggagtgatctcatccacaatttggatgggtcttcccacatcaactaacacaatctaaatgctatcccactggtgcacctggaggctcatttctcaggtgcttcttgattctgtcaaggtgacaactaacacttacctggtgatgacatgttgggatttttatttatctaataatagttgtgtgtgcaactgtcaaaaagaatacagagagataccacaagcagtttcttcactagtaatactttgtaataacatagatcacaaccaggatatgaccataaacctatgacaattctgtgaagataatagaggatgcggtggtttgaataataatggcacccataggctcatatattttaatgcttagtcatcaaggagtggaactcatggataggattaaaaggattaggaggtgtggtcttgttgaagggagtgtgtcccaagagtttcaaaaccagatgccactctgtccctgctgcttgcagggagatcatggtgtagaacttttagttacttctccaacatggcatctgcctgtgtcctgacctccatgctccctgccgtaataaaaatggactaagtctcaaaaactgtaagatgccccccagtcacgtactttcttttataagagttgccttgatgatggtgtctcttcacagtaataaaacattgactaagaaagagtttttttttaaagcattttatttcatggcatttatgtatcacagtgtgtttaacaatttagttgttgaatagatacaaatattacatcaagttcttgcttaaatgtactaaactgctaaaagttcattcacaggattatgtgtaaatttcccatgggttttttcctgagaaaacccaagactgacatttctgagtcatgtggcaataataaaacaatttagttttgtaagaaactgcctaactggtaaggaagatacaatccaaattatatactgaaagaaatggcaaggccagtaatttagcaagtcagaggataactagcatgcagtagcttaggacatgaagcactaagaagactgacaaattgccaaagttcttatttgttatacattacattaaaactaattcagttatctaggtaaaaaggaaagattggaacactttaaaaaaggaaaataaaaccactgtgtctttaaaagataaacattagtttctgttgaaaataaaaaatggtatgccacacaacatcttcgcatgtctccccattccctaaataatagagtatgtttatgttataaggtaaaaaaaaatccccttaatttgaggcgaaagtgctaggagagaagtgagagacaatcattgcctcttttttctttcactggtcttattacatgcaggtgagtatattcctgaatagactcttcccagtctggataatgttacttgtatgtatgttttcaggaggtccatttggtattggagaacccattagtatgctcctccatggagaagaacatttctcttcttgggattccttagttgcctgtagttccttgtttaaggttggggccttgtgaccttttcctcatccaaaagcatgtattttggtgttatttttattttgctcatgttcaggaagttctgttggcaaggctttattttttaatttttaatttttttgtttttttgttttttgttttttttgaaacagggtttctctgtatagcctagcctgtcctggaactcactttgtagaccagactgacctcaaacacagaaatccgcctgcctctgcctcctgagtgctgggattaaaggcgtgtgccaccatgcccggcttggcgagactttatagatgcagcttctatcattactgagacaaaacctcacagcaattgccctgatcctctgtctcttacaatcctctctcctcctcatctgtaatcttctctgagacttaggtgtgagagttgtactgtagatgtatcttttgggactggtctacacaattctgagttttcattgcttgtagtgttctgtcatggcctccaactgttgtaaagagaagtttccttggtgtggggcaaagactataattttctgtgggtatgaggatagatgtttaaattgttggtaggaattatgatagtttattaaagtatgagttggtacctcttcaacatccatgatttcactatcattgactaatttgctagatttccagtaccaagcatgattccccttttgttgagtgggtcttgagttccattatagagctattagcaaccactaaagtatgtgtgccactgttgcacccttacagtgattgtgccatgctggcctttgatgtgcttcataagtgtcatagttgagtagaactattggttacttccctccgttagaagatttcatggtgccttctggtaccatgaaagttagtcttcatgaagggcacagtcaggtcaattcctgttcagggggtctctggcacctgtttctgaagtgcatggtgtcttcagcaatagggacttaaccttctatctctgagaggtaaccaagggtaacagtaataggttgtatactttgggaatctcttgaacagtgctccatcagataagatgagaaaaattcatttaactatatatatatatttatgcacaaaactacatgtattatctatcattttttaggtaaatagttaataatattattccttgcatttttggacacttttattgttttacccatctcttggattctcatgtatttaccaccttccccctttccttccgagagcctgcccctccccattttaaaaaccagatcacttgtgtcctgctattcccctttgtctgccctctaaccaccttctgtatttcctccccctaaccccactccctgtaagcactccttttgccatttccctaattggatgatttgtaccctgttcttcacctctctattgctctccagcccacctaccgtgtcaatagtttggaatcccaccaacagtgaatggggaactcgtttgagacctctcttattctggtcggtcccaggcccatttttcaaatgggtcatttttgattctgttttgtgagttctttgtagatcctggatattaatgtcctgtcagatatatagctgaaaagatcccaccccacccctcaccccctgtcttagttagggttttactgctgtgaacagacaccatgaccaaagtaactcttataaggaccacatttaattggagctggcttacaggttcagaggttcagtccattatcatcaaggtggaaacatggcagcatccaggcaggcatggtgcaggaagagctgagaggcctacaacttcatctgaaggctgctagcagaatactggcttctaggcagctaggataaggatctttaagcccacacccacagtgacacacacacagtggcataaaagggttatatgggttggggacaggtaggcaggctccttgtctcttttagcctcctctttcaagggattcttgttatctttaacaaaatctcagttgttcaattttatcaatgaagacctgggagctagatgctttggtacaagcctgctatctaagagaagcagagaaagcagccacataactttcctcctcagccaatgtccccaaaagaagctctccttcatgctgtctcaaaattccttcaaagtaaatgtctctcccctctacttcctgtgcatctgtatctatccatcctcctgattttgtcttattctctttttttctctgttaacttcctgtcaactggttgcttgctcttcctcttgacttgtggttgactttctttaatcttgtttacaatattgaagcagggtgctcttgcattaaaggtatgtgctacggctgagcacaccacagctagtaacagacattttcagtaaataacacaacctcaggcttatctgtgatcaaataacctgcaacatttctcgatttttgtctaaataaaaaggaaagattttaaccccagcacagtaaaactattcacaataatgaagctatttctgtcgagctgtccacaatgtccatcttcattttatttggcagtttcaggattaagtatttttgagttcaaagttctgtaaaatgttcatgtctgcctcatatgaactcagcaatttgaatgccctgagtagtatgtagtctgaagattacttttggtggtgtttgtcatcttagtggcaatcctggctaggtagaacatagtcaacccaaaggtgtccactgtttctgaagaacctagtggcagaagaggcatagggcaatttttcccagtggttagcattaccagaatccaggtgtattcgtactgtggggtcccatcatcttcttggagacctcaaagcttactgttaggaatggcagaaaatgtaagcatttaaaatgccacattcagcagaatcacattctattaagtacatctgagatacacaaactttgttcctagtaacctgcttcagattaaaacctgaaaacatgtatagatgaagtttatttctagaattagttaacacattgtatgactactagtatcatgacagaaagtctgtatatatgtatatataataatagtatatattaattttatatattttgagataatatttagtactttaggaaaaaaatttaaaagtcaaatgaagaccaaaagattatgggattagtggccatagaatagtcccttatttttttgttttcctctattccatagcaaatggttcttctgatatgcgacagagattttggatttttcctttaacacgcatgcacgggtttagagagagccatgctttaatcccaaaaccagcttaattttgaattgaattgggaccacataaagaccatttgctacttatttctgcagaaacaagctcgaggtgggcaatcccacttggccaatttaatttactcttttacttgggacattttctcctggtgatttgttcgttttcttcagatgtttcctgatcccctttctccatcccctcccctctcctatccatgttcctccctccctctgactctctcccctctcctatccatgttcctccctccctctgactctctcccctctcctatccacgttcctccctccctctgactctcacgactattttgttctgacttctatgtgagattcaagcattttcacctggatcttccattgtttaaaacttcataaagtctgtgggttgtatcatgggtattctgtacttttcggcgaatatacacttatcagtgagtacatatcatgcaagtccttttggttctaggttaactcaggatattttctggttacacccatttgcctgcaaaattcatgatgtccttgtttttaatagctgagtagtattccattgcgtaaatggactacaatttctttatctgatatttggttaagggatacctgatttgcttctacttttgggccattatgaataaggctgctatgaacatagtggaacatgtgtccttgtggtggtctaattgaatgtagggagttatttcaatttccttgtatctgcttaaacttgctttgtcatcaagtatgtagtcaattttggacaaggttccatgatgtcttgagaagaaggtactctgtgtgtgtgtgtgtgtgtgtgtgtgaaatattctgtagatatctgttaggtccatttgctttataacatccattagctccaatgttttttctgtgtttagtttttgtctggatgacttctccattggtaaaagtgggttactgaatgtagttgtatatattttatgtgtctggttctttaaaggattctatgtcctccagtgtcagttggctcttaggattctggggaaaagaggggatatttcaaaagccaacagagtcttaaatctgggagtaggattccggggtagcagagagggattccaggagatagaaaagtagggtcagccgggcgtggtggcgcacgcctttaatcccagcactcgggaggcaaaggcaggcggatttctgagttcgaggccagactggtctacaaagtgagctccaggccagccagggctacacagagaaaccctgtctcgaaaaaccataaaaaaaaaaaaaaaaaaagaaagaaaagaaaagtagggtcagagagcagcatgagaagggaatacagttggtgactttcttagttaggtttttgctgctgtgaacaggcaccacaaccaaggcaacctttatagggacagcatttaattggggctggcttacaagttgagaggttcagtctattatcattaaggcaggaacatggcagtgtccaggcaggcatggtgcaggaggagctgagaggtttacatctaggagaagactggctcctaagtggttaggaggagggtctcattggtcacccccacagtgacacactttgtccaacaaggccacacctcctaatagtgccactcactgggccaagcatgttcaaacccttccagtggcagttgagacaggagaagctgagctaagtcagagaagatactaggagacaggagaagaacccacaaagttgtaaaaataaaataaaagttacagttggtctccaacataaaaggctgcttgaagaaagaagaaacattaaaagacaagtggccacctctgtggctaggcagaatgggaggattgatttcaagtaccatagagcaaaatgcagggaaagaagagatggatacttggcttcaaaaagtccacaagggtatttgcgaaggctgttttggggacgggtctcacatgttttttagcagcagtgtttttctccttttcctcattttgggttgttttctctataaaagtctacgtgagcaactggaaaaaaaatcaggtagaattagagaaaagactggcttagcaattggaaaaaaggtggatctaattagacaagcctgggaataaaaaaatgaaagaaaaatgccaaacataagaaaagggagaacaaatcagttcattctcagtgactgaatcagaaagagggagttttccccaggaagaaagaagggacagaaatgtgtcaaagggcagtcaagtcaaagaatggaaaaactggaagacggtcagatgagacagactttttttcaggagacagggttaaccccacagcaccttttgaggacaggcagtccagggtcacaaaatcatgaaagcattccaaatagttatccagcatatgcctggtaatgtgggtaatcctcgaagctaggacgaagtaggatggcttcctgtagacgtgatgaacttaagatgttattaaagaggcaatgctggtggagggatgaactctctttatgtgaacaaactcctaaataattgggctactcaaaagaaatcactccctaaacctggagaagattggtaacagctgtaccagaggctgccccacaattgcaattggttgtcatgctggaaagaagaagccaggaatttggaacagtgcaatagagcaaagggaattaatatagtgaaagaatagttgataggtgaaggtcattatgttgatatacaagaacaggttcagtttgaagacacaatcagaataatgtcatttatcacctttaagagcttgcgacaatgttgaggaggcaaaacgaagtccacctcatttaccaaaaattatacaagcttagggaaagcacttactgattttttttttactaagattgatctcagcagtaaataagatcatatctgacccagaagcaggacagttgttgatagagaccctagccttcgaaaatatgaatacagacgataaaaaagtcataggacctctgaaggtgcaggcagtgctcagagatgaatggataaagaatatgattgatactggttctaacatataccatgctaacataataggctatagctagaggtctccaatatcaaaaggcctggtgctttaattgtgggaaatatggacatttgaaacaaaattgtgaaaaaggcatctcaaaggcataggcttccagaagtgtataggcaatgtggcaaaagttgccactgaacaaatgagtgcaggtccaggagagatattcaaggcaattttttgctatagggaaacaaaatgggaggggggcgtgggttagctcaaggctcctcagcaaaaagtgtgagctatttgccttttgtccgcaaggcaataacaagcagacagaaaaacagcaagtaagtattccagatctaattcatggtactacagacagtgctaatttggacttgggcattgtagtggtttggataggtttggcccccatagactcatgtgtttgaatattcttggcccagggagtggtactattaggagatgtagccttgttgaataggtgtgtgcttgttggagggagtgtatcactgtgggggtgggctttgagagcctcctccttgctgtctagaagatggccttctggttgcctttgcaacaagatgtagaactattagttcctccagcaccatgcctgcatggatgctgccatacttactgacatgttggtaacggactgaacatctgaacctgtaagccagctctaattaaatgttgtccttaaaaaggttgccttggtcaagaaaaactgatttgtttccttcaactgcttgttttttgttttgttttttttttttcttcttggctttctttaaaggatttattaatttcttccagcctttgcctttcctttgatttctttacgggagtcattcacttctttaaggacctctatcattgacataaagttggttttaaggtcttttccttgggggctggagagatggctcagcggttaagagaaccgacggctcttctgaaggtcctgagttcaaatcccagcaaccacatggtggctcacaaccatccgtaatgagatctgacgccctcttctgggatatctgaaaacagctacagtgtaccatataataaataaaaacatctttaaaaataaaataaaataaatactcccacaattaaaaaaaagatctttttcttgtgcttcagctgtgttggtatcttgctgtagcaggatagctgggtgacataatgccttgcctgttattggttgtattcttctgttagtgtctggtcatctgggtttggggtgattatacttggcactcatttttggatttgtcttttttttttttaagatttatttattgttataaataagtacacagtagctgtcttcagatacaccagaagagggcgtcagatctcactacaggtggttgtgagccaccatgtggttgctgggatttgaactcaggaccttcggaagagcagtcaatgctcttaccctgctgagccatctcaccagcccaggatttgtctgttttttttttattgctattttttgcttcttgatttctgtttcctctctggtcttctgggcagtctggcttgcgattgaacagagggtctctgacttctggtattcaggatggcctcttgttgagaagggagtctttatagggttggcaggtccccagacagtggggcatagccactgatgtcagtgcctacctgggtttctggtggccagcctagccagtggttaagcaggggctctcaacccaagttggccattgaacatggcattaagtataggagggagtattgagggtagggtggctgggcactgagagtgtgggagataccaatgggaaggtggacttgcctggagttctggtagctgatctggcctctgactgagcacatgggttttgctcttgatactgtttctccactggcatctgggattgggatgattatgggtctaggtgctggttttgtctttgttggttaattgttttgttccttggtttctgcttcctccctggacttgaggagagtgtgttggttacatgtttcctggtagaaaatgttctgtggacctgtttccctgtcctactaagctggtttgttcccagggaaagtctgctggtgttggaggctaggataagttgggagagggaatgttacaggagaagatctttatgatccattgaggatagggtctgagaaaaaaagggagaccacagcagatattttacgtcagggtccaggatgagcctgaagggattgtacctggaggagtagaaagagaggtgaagatacagttagtttacctgcttccctggcaggagtggcttttggattagcatggaatgcctgctgttgttgggggctgattgaaagcactgagtggcagaagagagattagaaggggagcgagtatcagtggactccacagcagatgggtataggggcgggcagggaagtctgcatcaggtattttgctgcagagctgggttaaagactgttagagtgggtctagagcaactgaaagagagctgacggtctactgtcagccttcttggttccctcaaaggagttgagatacggagtttttaaatgataatttcatcaagaagatatgacaaaagtgcacttaacaatagctgtaaaacagctttttttttctttttgcagaaatggaaaattgatccaaaaatttatagagaattgcaaaaaattgtaacagttaaatattattgagacaaaaataaagctagggtatttatacttcaggatttactacttactataaaattaccacaataaagataaagtaacttgggctggagagatggctcagctgttcagagcactaactgctcttccaaaggtcctgagttcaaatcccagcaaccacatggtggctcacaaccatccataataagatctgatgcccttttctggtgtgtctgaagacagctacagtgtactcacataaataaaataaataaataaataaataaataaataaataaatcttaaaaaaataaaaacttcgcacacacacacacataaagtaacttcacacacacacacacacacacacacacacacacacacacacacaccatattacgtttaggaaaccatgatacacatcaggagtagctcagaaattttattatatggccatcttggagctcctaatgtatgattctattatgcttcggttctcaaatgtgactcagaggaccacatggttctgactcagcttgtgtgtggtactatggaaagtggtggaagttttcatggtcagacccagtgtaagttatgaggccttgaatatatgtggttgaaagagatattgggatcccagtccctttggatctttgatcctcagttggcaaatggtgaattatttccgtccacctcacgattatgccaccatgattttactgtggcctctatgggtccaaaggaattgaagcagatgaatacagactgaaccttataaaactatcaaccaaaataaaccttgcccccccatgagtgttctcagaatcagtgaaaagctgactagggaaactcccctcacacatgaaattcatctgtattacttttgtaagtttttttgtgcctatgacattcttttttattagatattttccttatttacatttaaaatgttatcccctttcctagtttcccttctgaaaatcccctatcccttttccataagtttttcattaacattttttacattcattggtggtgtgcctgcatttatgtctgtgtgaaggtgtcagattccctggaactgcatttacagacaattgtgagccaccatgtggttgctgggaattgaatctaggtcctctggaaaagtagcctgtactcttaactgctgagccacatctccagcccctcattaacaatttttaattgtggcaaaaatacattatagaaaattaacatcgaatcattcagtacactaattgtgttatcacatttttccttaacagatctccacaagttttcatcttgcactactgaaactttatactcactaataagtcccctatctcccatccactctttagtaatgaccattctattttctctttctatgaatttgattactttacatgagttaaatcatatcatattacttttcttgagactggtttgtttcactttgtataaaatgttcaaatttcattcatggtagaataggatttccttcattttggaaatgaattatgtttcattgactgtttaagactatattttgttatttattatcatattttaggttatttccaaatctgagaattatgattggtggtatatataatgagcatagttatacacagaccccctcaaaatcctgctttcgattcatttgggcatatatgtatcttggggggggttgtctggtgttgctatgtattcaaatattaaatactgtcttccatatctggttgcccctaacaagcagatcctcacatacaccaaatgatgctatgtaaatttttcttgttctatttgctcactggttaaataaatatggctacagccaaatattggggagaataaaggtaggcagggcttcacttacctggctgagggtcacaggcagggaccatgaagagaaagagtaggaggaaggagagaggagaaagaagatggacaggacaaaaggtctccattagatgtgatgggcaaagagcatgtggtctagtgaaatgcccccggaggaaagactaatagagcagaaataaccccagggcgactcaaacaacaaatacttggggagtgtaggtggggaattaacagtctagcgtattgtactagggttctctagagtcacagaacttatggaatatttctctatattaagggaacttattagtctccagtccaactcacccagcaacgggaagtccaggaatctagtagtttctcagtcccacaagtttaggtgttttagttggcctcctatataagccggaatcctgaagaagtagattccaacagatgtgctggcaagtgctgtctttcctcaggctgcctggggttcaggactagggcaaaatacatgctgatttggcacacatgattctggggatcatagtataagctaagacacagcggtgcctcccaaaacaaaccaaacaacatggcacgtggcagatttgaactccagcctgggatcttcccaaatgctgctctacgctgccttggagatgcagctgcatctcacagacgctaaaagccctagctgcacgacgaagcaggcaaagttctgcggcatgcctcttgcaatcaaaatttttagagaacatcaattaagatgtcaatgctaccttaaacaattggtttccttcaacatgggctcccttggaatactggaactacttagcacatgacacataggatggcttgagaatatgcttattcagtaaatagaaggagacttaaaattaaatatagaaagggatattaacttaatttttataaagagaaaggggatgtaagtatatttattcacagaagggagaaataaatggaaattgacataaggatacatggatgaatgaataaatccaggcatttgatctcagtgcttagaagacaaaggtaaggacagtgaggtttcttgtgaatctgaggccagcctaatctacaaacgaatccatgtcttaataaataataataattgtttttaattgttttaaattgctttgttttaacttatcaaaatgaatgtggtcataagttcaatggttataatggtgtcttagttagggttttactgctgtgaacagacaccatgtccaaggcaaatcttctaaggacaacatttaattggggctggcttacagactcagaggttcagtccattatcatcaaggtgggagcatggcagcatctaggcaggcatgatgcaggcagagttgagagttctacgtcttcatctgaaggctgctagtggaagactgacttcagacagctagggcaagggtcttaaagcccatgcccacagtgacacacctattccaacaaagccacacctattccaaagggccatatccctgggccaagcatatagaaaccatcatattccattccctggcccccataggcttgttcaaacacatgtatcaatgggggccatatctaaacatagcacaataaaaatacatttattccaacttccaaagcccccatagtctatatcagtctgaacaatgttaaaagtccaaagttcaaggtcttgtctgagattcatctaatcacttaactgtaatttccagagcaagactggaaaccagctgtgcaaattccaaactctgtatctctatgtctgatgccaaagcagtcttcagatatacaaatccttactcatctttgttgactgcaacacaattctttctcttgagctggttccactccctgttagcagctttcctcagcaaatatcctatggttctggcatctcaaacatcttgggggctccaaggcagcttcaatgttatagcttcttgtttcaatatctgggatctacacataatcttctggactcctccaaagggcttgggtcacttctccagctctgccctctgtagctcaagttgatccactccactggtgctactgtgcttggtgatcatcccatggtactggcatctccaataaatacactgagatcttctgctggaactagatttcaccaatagcctctcataagctctctctatagtgccaagcctcaaatcctttgcatgaccccttcagtcctggtctgtcaacagcgactgaacctgcaccttcaccaataaccctccatggcctctcacagtgccaagcatcagctgctaccccttcatgtttcaaaatcagtactacttgggtgattcttaaacattaccaagtagagctgcagcacaaggtacaacattgactatctctggcacacagcttctttgtgctctcagaaaacatttcccagaagatttcacctcagtgatactggtctctctctctctctctctttttattagatattttcttcatttacatttcaaaagctattccctttcctagtttcctctctgaaaatcccctataccccccctccccctgctccccaacccacccactcacacttcctggccctggcaatcccccatactaaggcatagaatcttagcaagaccaagggcctctccttccattgatggccaactaggccatcctctgctacatatgcagctagggaatatgtgttttctttgattggtggtttagtcccaaggagctctgggtgtactggttagttcatattgttgttcctcctatagggctgcagactccttcagctccttgggtcctttctctagctcctccattggggaccctgtgttccatccaatagatgactgtgagcatccacttctgtatttgccaggtactggcatagcctcacaggagacagctatatcagggtcctgtcagcaaaatcttgttggcatatggaacagtgtctggtttggtggttgtttatggggtgaatccctggatgaggcagtctgtggatggtccttcattttcagctccgaactttgcctctgtaactccttccatgggtattttgtttccccttctaagtatccacactttggtcttccttcttcttgagtgtcatgtgttttgcaaattgtatcttgggtattctaagtttctgtgctaatatccacttatcagtgagtgcatatcaagtgacttcttttgtgattgggctacctcactcaggatgagatcctccagatccatccatttgcctaagaatttcataaattcattgtttttaatagctgagtagtactccattgtgtaaatgtaccacattttctgtatccattcttctgttgagggacaactgggttctttccagcttctggctattataaataaggctgctatgaacatagtggagcatgtgtccttattacaggttggaacatcttctgggtatatgcccaggagaagaactgctggatcttctggtagtactatgtctaattttctgaggaacaaccaaactgatttccagagtggttgtaccagcttgcaataccatcaacaatggaggggtgttcctctttctccacatcctcagatgctggtctcttcttaatcactactaatttcttagctccagctaaccagcatcaattgtcccagtagttccttctactctttcctctaaagccagagccacatggccaaagctgttgtgttcttgccctgacctgcagggataatcagctgggacccagggcaagggagttagagagtggaagagaaagagacaggaagaatgagagcaagtcaatcatactgatcaagctctgaaaactttattcaagagtggcaatataagcataagcaagaggaggctccaaggaacggggaagagcccaggggctctctgaaggtcaggtggcaatcttcagctcctgaagattttgtgggtcacagtgtcctctttacccacaaatattcttagtgttatgaccacgaatgttctctcaggattgtttatgtaagctagaaattatccataaggccatggctgagaccatggccccaggcatctcctctttttaaattattttcatgaaggccccatggaactggggtgatcaatagtcatctcatccttggatgagtgggcgttaactgggcgggggaattgacctgattcctcctgtgggtaccatcaggacccacaataatgggtcttggtatcttttggggaggggagtgagagccttagaaaaatctttagggtaaggttgaaaacagataccaacctccttgcaaaccaggtttgtctcacaggtaattcagagatggtcagttttagaccttcccctgcagtgcttagcctcgcaacccacgctggttgcccatactggattcatttttatcaagaactagtatgcacaagtctgaatcctatgcatctcctgaaggagaattatcaacctcaggttcagcaagacctctgtcatccaaatcaagtctatgataatgaatttgcaagggtctcgacgccaagaaatcaatctgctgttttttttgttttttttttttgttttgtttttttttcttggggggggggtttgagacagggtttttctgtatagttctggctgtcctggaactcactttgtagaccaggctggactcgaactcagaaatctgcctgcttctgcctcccgagtgctgggattaaaggcatgcgccaccacgcccgactccaatctgctcttttataaaaccagtaattctgttaaaaatgaaaggccccaaagttactaataataaaatgcttattaatggtccaaggaggggcattaagagggtgaacatagagggcatcaagagggtgaacatagaggacttccaccaattatcagcagtggttgaaaactgttttctctggagctccaatttaagtttatgtaactgttgaactcgagtttccactatacctgattcatttacataaaagcaacattcttcttgcagaaagagacaggtactacctttctcagcggtcagaaaatcaagtgctcttcaattttgtaaggcaacttgggcaagggaagttaattgtctctgtaaagaagctaatgactcaatggaggcttccactgccaacgcaaattgttgagataatttggtaatggtgagaagagaatgggttaaagatcctccagccaaactggcagccacagcagaggtaaccaagaagatgctggccactgcagggagggaaatagctcacttgattctaatatctggggggctattccagctcaaatactcggcaggagttagcaaggtcaactgaggaactagggttacgggaagacacaacaattcttatttatgtttttggaaagaataagagtaagggtaccattacaccaaaataagaacccttcaggggcaatcagatcctgactaggtgagctggtttgattgcacaaattatcattgggactagtatagcagaatttaaattgtttttgttcagggatcaaaaacaaggatacttcaaaaattggggaaaaagttttacaactggcaccagacattttaaaaaggatgggataagggacagctgtcaatggaggatatcctaatgcagcacaaaggaagcaggctgagacatttcttaatccagtaatattggcaagtatcaggccctctcttaagagagatagccaggaaaaagggtgatgtgtggacaaaatgtagagctgtgtactcagctccttttctttattctgtatctattgttctaagaagctcataatttttttccttgcaaaactagggcagaagtgcctgtagctgtgcctcccacaaaagtatgtggagactttacttctaaatctttagtaattaatttctctattgatggcgaaatttcctccagcaggcatatctatcaacttagtgttgtttaccattaccgcaacttctaggccttcccatactattggatgtaataaagggtggatcagggatgaaagcccaatacaacttctctatcatcgtcaggacactttacaaactcacgatcattctttgtcccagcatcagtatgtctcactaaccactggcagctagcatgctccttcagcatcctgcagaaaaaacacaaacatgccctcttccccacactcagagagttccttgccattgaaattttaaaatttttgtgctgtacgggaatatgattccccctgttttatattcaaaagccaatttttcagagtgcaatgcacacattcaacaattccttgtcccatggattataaggaattccagttttatgttcaattccaaattccttacaaaactgtgtaaagttgtttccagtataagcagggccattatctgtcttgatgattttaggcaaacccatagcagtaaaagcctgcaagcaatatcaattacatttccagaagcttctcttgtatgtagagaagcaaaaatgagtcctgaacaagtgtcaatacagacatgtatgtatttcaaatttccaaaatctgaataatgagttacatctatttgccaaatatgattgggcataaggctttgtggattaacccctaaatgaagaacttgaaacaatataagacagtcaaaacattgctttaaaatcattctagtgggctggcgagatggctcagtggttaagagtgccgactgctcttctgataagtcccgagttcaaatcccagcaaccacatggtggctcacaaccatccgtaatgaaatctgatgccttcttctggagtatctgaggacagctacagtgtacttacatataataaataaataaattttaaaaaaccctcaacagtgatcacaactggacagattaaaaaaaatcattctagctttcttcttaacgatcttatgtagaagccttaaggtatgactagaaagatgaattttattgtgaccacatttagccaaaacataagatctgaaactaaagcttctcctatcaaagcattgtcaatacaatcattgcctgcagctaaaggtccgggaagatcagaatgagctcttatatgaccaatataaataggattttttcaagcaaaaatggtgtttgtgccacatcacctccagtaggatctgtgtgacaagttccacagactaaggcaactgacctcaaaaggtcctgtaggtatatgagttgtattaaaaataacaaatgtaaaggcaaagaataatatatataagtagcaaattgtttttcagtaactctttctacttgttgtaaggccaacaagttaaaactcgaggagaggtaggatcagcactccccctaagaatatcaataagggttttaattctcctgtagtaagctttaaacaaggaagaagtaaagtaatatcagctaacagcttttgaaaatcatttaaaggtttaaaattgttcctatgaataattattttctgaggaaaaccagcttgatctgtaagcctaaaacctaaataattataaggatcttgagtttgcactttttctggagctatttgtaatcctttatgagataatgcctgttgcaaatttctataacacagaagcaagtcctgaggatctttccctgctaataagatatcatccatgcaatgtatgatgtatatgattcattattgctgtctattaggctggatggcttgtgccacaaatttttgacataatgtaggactgttagccatgccttgagaaagaactatccattgataccttttcattggctctttaaaatttatagaaagaacactgaaagcaaatctttcacaatcgtgaggatgcaaaggaatagtagaaaaacaatctttcaaatctactgctattttatagtattctttatgaatgtctccacctgcttgatttttttttaagatttcaaaacactgggtacagcacacaattaaattatctgtgttgaagcaggaggaaactcaaaagaataaacatgtgatccaatcacatatacttctatcccatagaagggctgtttataaatacagttggtgttttctttatgggatgcatgcataaatttacaagaaatacaaaagcatgcacagaagcaatttttagcaacttatctttttataatgattatcaattttacctaaaaagtttattatgcaatagacaaaatatcaatattcagcaataaccaatttaattgctgtttgagacaagaaatagatatctcatcaggtttttaagactttaaaaaaatcttcatgattttatcttacaatccttgattaacaccacaacagcttcataataggatgttaaaactttacttggagatgaaaaaagattattccccattaatgttctcttttgccaaagaattgctgtaggcacattgagtaacaataaccaaaattagcagctaatgtttgattaccattgattacaattgataacaattgattacagaagcttcctctactctatatggagtaggcaggccagattgcaatgcctttagaaggtccacagcctcattgatatgtcatacatcttaagtttaaactttattttgaacaacacctggataaatctgttataatgttgttttggcttaaaaataatttccaggaggcaaggagaggtgaggtcccaaaacttccctaggcacggtttgcaaaaccaaagaaatgtcacacaagcctcactgaggctgctctgagatttgcattaactcaaatataaatatttttttaatctgagcatactgccagagtcctggccaaagatcctgcagtgaggacagattccaggggaacaattcgactgtctgaccatgcctttaatttttggacagtctttcttaggaagatttatacttaaaacattccttataaccttagtgctgtgaaagcattgcttgtactgtagtggcctgcaaggcagcaaccatagctaaactgattgtatgagggtccaatttctgcacaaagatgaatatacccagataagtctgtctttgctttgtaaggccggatggctgcagggagctgcattagtgtcctcataaggtaaactcttgtaatcatcctaattacaatatatgggtgagttaaaaatcctgagcttgcaatcaaactgcaaactgcagtcaatggaacactggcaattttaacaataatttttaagtttcttttgcaatattagaatatatccataacttttggaacgcaaaacccaattttaaacgatatattctctttaaaatcaataccaaaatcatcactttcacattacgaagtttggctgccaattcttatatatgaatgcatgacagtgcagcttttaatacctcattgaagagacattgttttaaattctatccttataaatctaatttctagaataataattacataaaatattatcccaatttagaagtatcttaaaagacctgttttcctcagttggctcatcccatgtgttgtttagaatgactccaaccctgagttaccaattttaagctaactttctgttacaagcaaaaagttgttggcccctttaagagttgcttgtgtagataatcagcctctagcagggcttttccagctgtgcttgactcctagccacagtgcagtgtaacttatcagattctgctctgcaaattgagactgccttttaaacaagttaaactcaatcaaaggatggacagccagcagataaagttttatccatttttttttctttcaacatgaaacacagaacaacaatcattcaatcaacaaaatgaaaacaaatataaattgacacacatatagacaaattggtgcaccaaggacagacaatagacagagagggaatagaacttggtgtctcaaaggggcccagatatcctaactaaaactaagaatatcttcataggagccagagaggaagcaagtcgtctcccgatttccttctgtccctaggagagctctgaaatagcttatttccattttccttctcttttgctaaaaggtctcgaacaggggacacctgcttttctgaaacctattctctctctctttctctctctcatgttcaaagtgtaactctttatctccttcttctgggaattctgccagagaagggagaggaggcacagtggtagctactgatagttgctccccagtgccctgcttttctaactttcctaatcactcctcaacttgtctaattctttcatttatatatttaccattcctacttctgggaattaagaacaacataaatgtgcttgagctaaaattttttttctaacatctgttattttgtttttgtagttttgattttcactctttttattaattttattttattttaaaccctattcctcccacctggagcagctcttggctgtgaacaaattttcttaacccgtattcctcatgatttgagggattccttgagatccctttaaaaacaattcatgtttacttaatgcttgtcccatagtctagccactcttcctatctttctcagatccggatctgtctcacagtgcgggtgacactgaggctatcctgtgcaggtctatccactgtgagccttcactcacttcttgacaaagcagcagttcagtgtgaagagtgatctttctcagatcccagacccagaagccacaagctgggcaccagtttgccccaacctgcagggataatcagcagggacctagggcaagggagtgagagagtgggagggaaagagaaacgaagaatgagagcaagacaatcatactgatcaagctctgaaaaacttgattcaggagtggcaatataaacataagcaagaggaggctccaagggatgggggaagagcccaggggctctctgaaggtcaggtggcaatcttttcagctcctggaaccaacggtcacagtgtcttctttacccacaaacattcttagtgtcatgaccacgaatgttctctcaggattgtttatgtaagctagaaaatatccacaaggccatggctgagaccatggctcctggcatgttaaaatgctcatgggggctggaacatggttcacttattctattaccagctttctgttttccaactccctcactgactaagcttggctggatgggatcttaccctaaaaatctcttaatctgttatgtcttagaacataggattcagcttgatttcacttcctggtgcccccttaaaatttaagccatgtattttatatttttaatttctctgcttgctaggcttgtttgaaacactcttcatgagacttaaccagagaacaaagtctctgatgggcttttttgagactttttttttttgtcaatgccattaatctgagtctcttcaccccagcctcagacagacttttcagacaagggcaaaaagtagccacattcttcaccaaaataccacaaaacattcctgtaggccacattttgaaattcctcactgaaatctcttgggccaggtccgcacagttcaaattactctcaataacaaagtcttccatattcctactaggatagcccattaagccccatttaaagtattccaccgctttccaagtccaaagtccccaaatccacattcttccaaagaaaagcatggtcaggcctatcacagcaacacctcagtccttggtaccaacatctgtcttagttagggttttactgctgtgagcggatacaatgaccaaggcaaatcttataaggacaacatttaattgggctggcttacaggttcagaggttcagtccattagcatcaaagtgggagcatggcagcatctagacagacatggtgcaggcagagctgagagttctacaacttcatctgaaggctgctagtgtaagactgacttccagacagctaggatgagggtattaaagtcatgcccacagtgatacacctactccaacaaaagccacacctactccttggggcagcatatccaaaccatgacaaatggtattataaattctccatgagagaggtagaaacagagcagaactaaatagtaaagaggctgctaagttgaatcaatctatacttttgatgattttgggttgctcgaccaagtatatactatttttggagagaggctttgtatttgtgttaacaggaaagaataaaaaaggcttggactccttccaaagtaataaggatcagatttgttagaggaagatgtcctgaagatcttggctgcagacaagaagaagaaaatcaagaagattgaagaggacaagtaacatgatttgttgatccctatacatggagacagccctaaaactggctgagacataaaaatgtctctagaagaacttcaactatatatagccaatggatcttgttggctacagaggcctcaaaattcattgtgctatcctttcctatggcaaaaatgaagatttatattacaatttggtttctggtcatactaaccataaagaaagacagttgtctttcagctgctcaaacaaccctccaaaattaattttcaattaatgtgtgcaacctacacattacatacaaatgtctttatagaaccatgtacttcatgtgaagtttgtatattgcagaatgaatgactaggagggaagtcctgaaaaaggattcaccctcaaggatgctccctgcctgttcttgctgcccaactgatgctatttccagagacttgctttgagaacaatttcaggaagggcttccctgatgatttcagttcatccagccttttagactgttccagtcaggaaataatgacagctaataaggctttattttgatttaaccattttccttttgggatcccaaacaggaattattaaccccaattcagcaggaaacaattataaggataccatggtcctagtcccttaagttgagtggatggttttggttattttatgaattatagatatattgttatgtaaaggaagatttacaaataatgatagttttggacaggaataaactaagtagagaacttagactcagggatttctatcttcccttccctctttttttttttttttttttagataagggaaggagagttcaggaaaaaaaggagagaaaaagaaaaattataagaaattagaaaaatggggtagattattgaatctactttaaacaatagtattttatcaccataatcctaccttggtaaaaattgttatattttgatgcagaattgagtctatattttgttacattgatatagaattttgtatattgatacaggtttaagttttgcactggtataaatctttgtatattgatacaaaatttaagattaattttgttactcttagataggcattgtgcctatgcagctcatttaaaaatacaaggcttcagccgggcgtggtggcgcacgcctttaatcccagcactcgggaggcagaggcaggcggatttctgagttcgaggccagcctggtctacaaagtgagctccaggacagccagggctatacagagaaaccctgtctcgaaaaaccaaccccccccccccaaaatacaaggcttaatcctactcctttatagctgctattaaaattatttaagataatcaaataaagcaattcaataatcaatcaatcaaacttgtagtcaggttagatattagtctgaattatcacaaaaatatacatcgtgggttatacagataataggtagctggagacaggcaatgtttgtttgttcagatatgctatgaatagatagatggtcttcaaaagagtcagagatccacagaatatgtcacttaaaatcatgtcattattaaaagatcttttctagatttgtttctaacggtacccccattctactttaaagatgatgagcatcaataacctacatatgaggttgcttcaactgtggccaggtaactactgggtaaaaaaagccctaggtttatttgcagacagaatgctgtccaaaaaggacaaatggaagtaggatagtcaattgcttagctttgccaagacaggctaagctagtccttcataattcctgcttcacttaaagcctgtcagatatcctgggctagaaggctaaagatagatgctccaacattataagcaatattgggaactgtccaggtggtaaactatctctgtcttttctataatttttggacacttcatccctgcacttcctacatactcaaatttttatggtctgacctccctccccccagaatatctgtagccatttgctccatacctgctagctatttcatcttgttgctttaacatgcctacaggttagtaacacagaagtgacttggctcaaggacatgctgagcacataccctgtctgttctgtatgttctgtatgtggtttgctaatcttaagaaattccacaaagttttacataggacctatcaaataaaagttcaatattaactgttatgtctaaaatatcttgagtcagagctgactgcctggcagcccttcccacacctacctatgagctcactgtgaaatttgtggctgacatgggagaatgctactagtaaaccaaaaacttatgataacaatagtcaagatctattatctcaaagttctgaaagtcccctgttcaccacccatccccaggaccaatcagtttaaagattaggtgataaacactttgcctagtaagccaactgcttccctccttgccctttaagcttttttttttttaatttttttttttggtgtgatttcacattttaaaaaatggatattttctttatttacatttcaaatgctattccctttcccagtccccctgtaatctcctatcccctctccctcaccctgcttctatgagggtgtccccccaccctccctcccactcccttctccctgccctcaaatttccctacactgggcattgagccttcataggaccaacagcctcttctcccattcatgaccaacaaggccatctgctacatatgtggccacagccatgggttcctccgtgtgtactctttggttgatggtttagtccctggggtctctggtggagggtctggttggttcatattgttgttcctcctatggagctgcaagttccttcagctccttcagtcctttctctgactcctttattggggaccccaatctcagtccagtggttgtctgcaagcatccgcctctgtatttgtcaggttctggctgagtgtctcaggagacaggtatatcagcctcctgtcagcaaccacttcttggcggccacaatagtgtctgggtttggtgactgtatatgagatagaaactgccctagtggggcagtttctggatggcctttccttcctcaattctctgcttaatactttgtctccatatttgctcccctgagtattttgttcccccttgtaagaaggaccaaagaatccatactttgatcttccttcttcttgagcatcatgtggtctgtgaattgtatcttgggaattccaagcttttgggttaatatccacttatcagtgagtgcatactatgtgtgttcttttgtgattgggttactttactcaggatgagattttctagtttcattcatttgcttaagaatttcatagactcattgtttttaatagctgagtagaactccactgtataaatgtaccacattttctgtatccattcctctgttgagggacatctgggttctttccagcttttggctattataaataaggctgctatgaacatagtggagcatgtttccttattacacgttggaaatgtaagaccccccccccccaaagctgggcctccactcaagtctcggtatgagctggccagcaccccagtgacccgagagaaaaccacacctgatgcaaactgcaagaggttctgccgtgcagggcaggggagatagaccctgagcggtgacagtagggggcttttaacagctagctgaggaattgggaggagttgggaggagagttgggaggagttgggaagagttgggaggagttgggaggagttgggaagagttgggaggagttgggaagagttgggaggagttgggaagagttgggaggagttgggaggagttgggaagagttgggaggagttgggaggagagttcttctcttccgggtgtccttggtgaaatttacaaggcaggagtagggagtgagttctttctgaatttttatctccgtgtcctcagcacaggaaggcaggcatctctggttgtaaagtatagaaacaaaaaggctttttgctggctatagagaagaaagagcttctttctggctggatttttagagatcagggaaaacaagcttggggaacatccagggctttaccttccagggagaaatgctctaagttggggtctcacattccccactccttctagtacatagttctaatcttagaactaagaaaattaagcctctggcccagctgtcaaataagaccaacatgaggtcgcagcttttggatttgtaacattgagagcctcagaagccccttgaatgagactagagagtctctcatcagtggtaggagggagggaggaggttcctgtgccatgcctggtgagtgtgagtaaggccaggccagtgggccacagcagggctgggagagggagccgggcgcatgtcagaggagcagcggggcttgtcagaagcaccaggtagggtcctttccatctgggttcaaagttgctggaacggcggcactggaccaggacaggatctcctatttgaaatttatgtggcaccacggtcgttcctggttcatatgtttttttttcagcaattcccaggtgtcttttctgaccagttctagggcctttaagtgatctagcaggggttggggaaaaaaggagcatcaaggtcaaacattttcctgcttctgttaaggggggcagtcccccacggaggagttcaaagggtgtaagtttaaatttccctggggtgttccatactcggaacaaggcaaagggaaggagagctgtccaatcttttccgctggtttctaaagccaatttcgttaaggtttcttttaatgttctatacacccgctctacctgtcctgaactctggggtctataaacacaatgtaacttctaatctatccccaattgtctggctaacccttggcttacctgggcaatgaaggaggggccattgtctgatgaaagtaccttaaggatgctgaatcttggaaaatttcctctaatatcttctttgccacaacattggtggtctccttcttagtggggaaggctttgacccaccctgaaaaagtgtctagaaaaactaatagatatttattaccgtacttggctagtttaactttagtaaaatctacttttcagtatgcccctggccggtcacctcttagccaccttctgggggtgttcttgtggtgcccagcattggtgagggcacaggcttggcatttattaacaatctcctgggcaacgtcggacagttttataacatagtagtttgagttcttaacaatttctttgagcttcttagtttctaagtgcgtgagccagtgtagattggctacatattgttgtcctttggtgggcaggaccgagtgaacatcttgggtcttagccactccctggggagtatacctacacatctcaggtattttgcctgttagttcctgatcttctggagtgtagtcaaagcctgtgtctttgagttcataatggtccttaagttctttatttttctctctagctatgaggatcatagctctttgggccgcctgtttggcagccaggtcagccatctgatttccctttgctatggcatcatggcctttctggtgaccagggcaatgtatgatggccagtttttttttttttttttttttttttggcatctaataggctcaagatttcttcttaaattttaatcccctttgcctatagattgtcccatgtatgtgagcggtggtgaaagcatacctgttgtctgtgtagatattgatgttcttctctttggccagccacaaggcttgggtgagtgtgattagctctgctctctgggctgttgtcccttcaggcaagctgctgtcccagatggtttgttttctgttgactactgttgcccccgcttttcacttacctttaaccaaaaggctgctatcattcgtgtaccagttggggcagtctggccatggctggtcagtgagatctttcttagttccggtgtcttctgccaggatgtccatacactggtgcactggtagggagtaggtggcttccagcagcaaggtggcaggattcagggtagcagggggtgcaaactgcactctttcagtcagtaagaggctcttataatgggtcatgtgagcattagtcatccagcaatcaggcggttgtctaacgatgctttctaaggcatggggggctactactataattcgttgacctagaatcagtttgtcagcatctttgagaatagtgccacagcagcgatagcttttaagcaagatggccatccactggccactgggtctaatttcttttgacaagtagaccacaagtcatttctatggccccagagcttgggtcaggacccctctcactattcctgctctttagtctacatagagagtaaaaggcttagtcaggtccagcagggctagggctggtgaactaagcaaggccttttaaatctctttaaaggcctcctggtgtatgggtgtccatgagaaagtctcagtctctttagtaagggggtagagtggggctgccagggtggcaaagctttttaactggtagcaacggggtattccaggaagactgacaagggaccaaaacaccttgttctaagaacctttgaatgtgaggtctgatgtcctctcaggcctctttgctcatggggtattgttgtaccccgataggagtcgcaccagttttcagcgttacaacaatggggggcaccttctttgcctctcccatacctctagtctctgccaaggcttgaggatatctctctaaccaggtcccttctagtacttttctcaatggggcttgaggttcatgtaatctatatatattttttctaattttaaagctaaaattatagagataggggcttgccaagagaatgaagttccttctgaagagaagcttatttgggcttttaattttgatagtaagtttctccccaacaatggggtggggcattcaggaatgaggaaggaatgagttacttggcttcttcccaaatcaactttcctatcagtgatccaagagtatggtttctgaccagtagccccaattattacggctttcttgttcctcaatttccccagtggctctttcaggactgaaaactctgctctggtatcaacaaggaaatctgtgggggtcccctccacagttagggttaccctaggctcggggagggggtccgagccccgtctcccctagtcatcatcctctagggtaaggaccttgggcagtctgatgtctgtctttttcttggggcagtctcttgcccagtgccccttttctttacagtatgcacattggtccttatctagaggtggtcctgaaggtcctctggagctctgtggtcttcttggccctgtgttgcccaggtaccctgtctgcctacttcttctaccttgtctataaacttccttatcacctgcgaatgtatctaaaatcctaattaaatttctttcctgccttctatcttgtctactttctcttgcctcagcctctctattttctctttctcctttttctttttcagtctctctcttatggtacactttctctgcttccttaaccagatcttgcaaagataatggttgcagaccctctagacactgtaaccttctcctgatgtcatgtcagaagcagactgccatggctactgtcacctgttggccctctgatgtagggtcaaagggagtgtaacgcctgtatgcctctaagaggcgctctaaacacactgttgggggctccttttcatcttgtaggatctctcttaccttggccaaattggtggggctcctgccagctcctctcagtcctgctaccagagcccggcggaaaactgtcaaccgctccctaccttcaggcctcttagggttccagtcaggatgtgtcagagggaagcctgcatctatttcattcggaagttgtgtcggccatccattggcccccagcacgttctttcttgcctccagcagaatcctttccttctcctctgaggtgaaaataacctgaaaaactgctgacaatcatcccaagtgggctgatgagagaacatgagagattccattagattagtaaggttagaggggttttcagagaagggggcgtgatttgccttccaattatagagatcagaggaggaaaaaggccggtactgaaggggctgcagttgtccagggtccactggaggagggccataagtatgtaaagtcagcatggtggttgagtctggtccctctgggctctgagctcactagcttcgggttccagcagcgggtccctcccctgagtctccagtggcaccctgttgagagatctgggaggggaccggttggggatatgggggtgtgatgttatgccattctggaggttcttctatctctggatagatcctgggaggagccaagggctgcagttcagcccacgctgttttatcttagtttttttctctgagtggcggagagccaggactcaggagcccagtttgttcttctgaacccaaagcttcaaccaggatgggggtcctgcgctaaattttcccagatgagaatgtagggcacttgatttggttgagaccctgccttcctttgcataacaacatgtttaacggcagaaatcacaatcaaatcaagagtgccctctggtggccaaccaacatcaaaagctggccattccgtagagcagaaagttctccaaaatctctttctgacatctacagacagattgtgagccctagtcttaatttcagtccaatgctcgagagtcagtccaaggggagtgctaatagtctgtcccattgtcagagtcacatacagggaaacaaacaatatatacacacaaaaagattacaataaccaagaccaggacctaatcagatggccgagtgagcacactctcacttggaacccagtaacagaaacagatggctgagtgagcacactctcacttggcaccccgatgggaaatctccaggtgtccctggagctccctcagacctcctgggacgtctcccagggtggcagccggttactcctgacatgtctgtcagtaaccctcccctccatcccggacagggagttcattgcactcacgagcacggatgactgcaaactgagaataccgaattcaaacacagacggcaaacacagacatagataaagatatagacaaagatatagacaaagatagacaaagataggatcctacctccaagcggggtctctgagaactggggtaggccacaaatcccggacaagcccccacatgtaagaccccctcccccgcccccccccccccgaagctgggcctccgttcaagtcctgggatgagctggccagcaccccagtgacccgagagaaaaccacacctgatgcaaactgcaagaggttttattatcagctagctgagcacgaagtccctccggccatgcagggcaggggagttcgaccccgagtggtgacagtaggaggcttttaacagctagctgaggaattgggaggagttgggaggagttgtgaagagttgggaggagttgggaagagagttcttctcttccgggtgtcctcggcgaaatttacaaggcaggagtggggagtgagttctttctgaatttttatctccgtgtccttggcacaggaaggcaggcatctctggttgtaaagtatagaaacaaaaaggctttttgctggctatagagaagaaagagcttctttctggctggatttttagagatcagggaaaacaagcttgggaaacatccagggactttaccttccagggagaaatgctccaagtcagggtcccacagaacatcttctgggatgccaaggagaggtattgctggatcttctggtagtactatgtccaattttctgaggaaccaccagactgatttccagcctggttctaccagcttgcaatcccaccagcaatggaggagtgttcctctttctccatatcctcgccagcatctgctgtcacctgaatttttcatcttagccattctgactggtgtgaggtggaatatcagggttgttttgatttgaatttctctgatgactaaggatgttaaacatttcttaggtgcttctcagccgttcaggattcctcagttgagaattctctgtttagctctgttccccaatttttatgaggtcccatttgtcaattcttgatcttagagcataaaccactggtgttctgtttagaaaatttccccctgtgcccatgtgtttgaggctctattgtactttttcttctattagatttaatgtatctttttttttgtggatgtctttgatgcacttggacttgagctatgtacaaggacttaagaatggatcaattcgcattcttctacatgataaccgccagttgtgccagcaccatttgttgaaaatgctgtcttttttcccactggatggttttagctcccttgtcaaagatcaagtgaccataggtgtgtgggttcatttctgggtcttcaattctattccactgatccacctgtctgttgctgtaccagtactatgcagtttttttttttcacaattgctctgtagtacagcttgaggtcaggcatggtgattccagcagaggttcttttattgttaggaacagtttttgctatcttgggttttttgttattctagatgaatttgcaaattgccctttcggactctgaagaattgagctggaattttgatggggattgcattgaatctgtagattgatttcggcaagatagccatttttactatattaatcctgacaatccatgagtatggagatctctgatttctttcttcagagtcttgaagttcttggcatacagataatatgatggagagggatttagaaacctgttcatattcagaagagtgactacatgcataagaaagaactgggaaaggagtagcttttagtcactcaccttaactgatcttgaggcatggtattacaaggaaatcaaagtatgggataacataaaaggtgtctgaaatttgaaggcatatatttacaagtagattaatttgttaaatggtggaaggcatagaccaaggaatttgtatatttgataaattttggctgaccaataaattagactgaaatggggatgaatcctaaaaactcataattaaactatgaattaaattagctgacagaacttacaggatgaatttgagaaaattactaagtaagcatgaaacaattaaagcaacaataataagactaaataaaactatgacaagaagcagcaaaacacagcattatgtcacatgttaataaaatattcaggtagagtaaagaaagcatccttgacaaaatctagatattggatatagtaaacatattaaataatgtacaaaaatatgctcaaactgtaatgctatgtttagcttaatgaaagcaatacaagtattatataatttactatatatgtatatatataattttgaagtaaaaaaggaaattataaatttgaatattttactagatgatcttaactatttgagttggcagaaaaattaatcagtgaactcaaagatagattaactgggataacccagaagtatcaaaaagttctatagggtatcatgaaatggacaaaaatgtccataatgagaattccaatatggaggaaaaataatgagacacagaaaaatagttgaaaaaaacaacaactgaaaagttcctcagcaatttccacacagttgtttctcctggtcaaatgtgtttacccttcatatcatatagcatgtgtatttagtggtccgatgacaagttcataggtgaagaatgtatgtcttagtcagcctgacatgtttgaaggaaaaagctttcttgtaaagtatttaaacttgtagtatgaaatgttgaaaaatcatgagagcaaatggaaaacgtgatttattgcatgtacagatgtatacacacaacctgccaagtcaatttttgtttgtgtatatattttttcaaggatgactactttgtaatttctgggctcatgtctgggagagactagttctcctcagtagtcattagttgcttgttgctctttgtctaggggtggagctctgtgagatttccctcttttgagttagcatgtctagtgatgttgttattgttaagttcttgtttatccagccatttctaagagacagtttcaaagaacacttcttggtcctctaactcttacagtctttctttcccctcttctgagatgttctctgagacttagcttgctgtgtaggagatgtttctgttggagctggtctctccactgttcattgatttcagtacggtgtgtggttgtggtttcctttaatggtttccattttcaaaggggaggagagtatttattacatcatgcaagtttagattctgtcatcaagaaagccagggcagaatctctagcagaaacttagaggcaggatctttcttcttttttttttttttaaagatttatttatttattatatgaaagtacatgtagctgtcttctgacactctagaagagggagtcagatctcattacagatggttgtgagctaccatgtggttgctgggatttgaactcaggacctttggaagagcagtcagtgctcttaacggctgagccatctctctagcccccaggatatttcattcttgctctgatttctgtaagcaatactgtgctaggtacacgggggctgttgggcacagagcagactatacaagaagggagactgaggccactaagtcatttgctgcctggttctcatttaagtggatgaataaagtccaacttctaggactggttttgaagatagtgtgaagtactgcacagagatggccacttggccaagacccttctgcatgaacctgtatctctattctgcccaaggttcactccatagaaacataccatttcttgtaatatgcattttgaggcttctgccattcttatttccctggctttttggaaaggtcttatgactttcatgtacttctaacatgctagcttctgttgcccctaatagtctttttttttttttttttttgagacagagtttctctgtgtagcccttgctgtcctggaactcactctgtagaccaggctggcctcaaactcagaaatccccctgcctctgcctctcaagtgctgggattaaaggtgtgtgccaccactgcccggcaactctcctattttgaaaaatgaaacatttatgacaaaacagggaaatctgcttttgttgtattgcttctttaaaacaaaaaatcaactattttattgggcactaaatgatatgcaacatactaataaaaattatcaacacttttttgtctattgatttatcagtgaacacataggctatttccaactttgaaagtttatatatatatatatatatatatatatatatatatatatatatattgttgcctatttgcatgtaacacatatgtgtctggtgtatgcagaggtcagaagaaaaagtctgatgacctggaactgtagttataggcagttgtgatccaccacgtggaaattgagaagcaaacctggttcccctagaagagcaggaagtgctcttacctgctaagccatctctccaattgtttctaactttctgctaatgtatatgttctcctctgaacatgggtatgcaaaatctgagactgctttcaagtttatatctctatcactatctatctaatctatgtatctatctatgtctctatgtctctatgtatctatctatctatctatctatctatctatctatctatctatctatcatgtatgtatgtatgtatgtatgtatgtatgtatgtatgtatctatatccagaagtgggattgcttgaacacatgataatcatgtttaatgcgttgagatattgctatactgattttcattgtccttactttcaccactgcttgctattttctgtattttaagctatctcaatcggtatgaaatagtatctagttatgattttgacttatatttacataactaatgatactggtcatctttaaaaacaaattttgaaaaatttctttattattggatgggtgtcatcaaggtgagttctaaggaacatgtgtggcagccagggtgcaactggacagagtcagttctctccttcaacatttgcatggctttagcattttccaggtttatacaacaagcaccttcacccaccaagatatcttactgcccctttcctagaggaaattttaatttactgcatagtcttctattgcatgaatcttctatcatatatttaactctctctttagtgctaatatttttattatttccaataaacttcaaaatgtcaagcaaattctgtgattttaaaaaacaaaatagtactttatatttggtttttctttgtaaaattcctaatggctttccttttgtttgttttgtttttgggtttttaagacaaaatttcatgtagtccaagctaacccagaactgctatatgtggaggctactcctgaacttctgattttccatctcagtgctgtgattacaggctaaaacaacatcacataagggaaagtggaaagacagtttaggactggggtattatcctatacgctcactagtcatatagctggctcttttacaaaaggcttcaacacccctccccccacactttagtcatccgtcatctcttcctcatcaggaaatattatgagaattttcccatttaaaatcacacaggttgtgaaaattacagaaaccagggtacagaatatttaaaccactgtcagttacatcatccaaaggccacctatgcttatttttggtaattttaaacctcaaaggatctctttgtgggctcctccactaccctcctctctttcccagagcctcaggttataaccaaagggatagactaaagacaatccagtaccttgcccatttttttcattccttgtcactgtttccatatagctcttttgaaattatgaacatatagtatcagttgaaaacggaatgaatgatactgcatttctgcaaaattccacaggctatagggtggaagatgagccataggtggaggaatcagccatattagagaatctgggaaggcaagaggtgttgaaattttgattcatctactaatttactggctcaggatttgtcaatcactgcagcctggcaaatgagattagagaagagtcctgggagggaaggggtgacgcagcaacctgcatacacttaaaaaaaaagagctgagagacaactgcgtaatcatactgcggcaccagttcctccatccctccgcccccgagtggctggagcagctgcttgcggaggtctgcccactgcggctctctgcagtctctagcctgttccttcagggcctagagtctccgcccagacagccggtttcaattctgctatcccagcttcagcaccgtcttttatccccactgcttgctgcctgccatcagtgcagccgccgccgcctcttggttcatctctgccagatcatcgcgcatctgctgtattggtgagtcttcctgcggaggtcaggtctcctgatctgcgggcttagccaccataagtgcaggcgatcgtttgaaaacaatggctgaatcagtcgaccataaagaactgtctgaatccaaccaagaagagcttggcagccaggtaatggcggaggggcccggggaaagtcaggaccgcagtgaaggtgtctccattgagcctggagatggcgggcaacatggtgaagaaaccgtggctgctggagtaggggaagagggaaaaggtgaagaagctgctgcagggtctggggaagatgctgggaagtgcggaggcactgatgaggactcagactcagaccgtccaaaaggacttatcggttatcttttagataccgatttcgttgaaagtctcccagtgaaagttaagtgccgagtgctagctcttaaaaagcttcaaacaagagctgcccatttggaatccaaattcctgagggaatttcatgacattgaaaggaagtttgctgaaatgtaccaacccttactagaaaaaagacgacagatcatcaatgcagtctatgagcccacagaagaggaatgtgagtataaatcggactgtgaggactattttgaggaggagatggatgaggaggaagagactaacggcaacgaagacggtatggtgcatgaatacgtggatgaagatgatggttatgaggactgttattatgattatgatgacgaggaagaagaggaggaggaagatgacagcgctggggccaccggaggagaagaggttaacgaagaggatcctaaggggattccggatttttggttgactgttttaaaaaatgttgaagcactcactcctatgattaagaaatatgatgagcctattctgaagctgctgacagatattaaagtgaagctttcggatcccggggagcctctcagcttcacactcgaatttcacttcaagcccaatgaatattttaaaaatgagctgttgacaaagacttatgtgctgaagtcaaagcttgcatgctacgatccccacccttataggggaactgccattgagtacgccactggctgcgacatagattggaacgaagggaagaatgtcactttgagaaccatcaagaagaagcagagacatcgcgtctggggaactgtccgaactgtgactgaagattttcccaaggactctttcttcaatttcttctctcctcatgggatcagcttaaatggaggggatgaaaatgatgattttttacttggtcataatctgcgtacttacataattccaagatcagtgttatttttctcaggagatgcacttgaatctcagcaggagggtgtagttagggaagttaatgacgaaatatatgacaaaattatttatgatgattggatggctgcaattgaagaggttaaagcctgttgcaaaaatcttgaggcattagtagaagatattgatcgttaaaacagagtagatgcttttgaaactaactgctctacatgcagttactgaagacataagcagttaatattgtcttgtgttctgcattttttcctgtcatgccagtttaaaaattcaaatactaattaatctgaccttgcattgtagtggtatgatgttttcaagacatgtagactgtgataaatgattaagacattaatagtctgtagtataacccttctgaagtccttgtgccatgtatctattaatctgtggctgtgaatattattagaagtgctaaatgagattatttgtttgcaaagaaaatattggaaacctacctaagagtgctttgctattttcccccttatcctcttagtgctttggccaattgactttattgtgcctgcttcattttgcagtaaatatgcagtagaatttaaaacttgaatgcctaagaggcctgcatatgattgagaatttcaggcaaaatcatatttattattgataacagctagtgcaaggcttctgattgtatgtgactgtgataaataataaaactcaattgtattgaagttactgtttatcattgacatgtgagttacagtattttcaaatgttgcaaatattgtcctgtgtaattgtgtaaactgtgattacagtgtacatttttttcataatatactgaatcattcattgaaatggacactttaccatttctgaaaatacatttcatattctgttcattcactgaaaaataaaatgaataaaaatttcatggtgttaaatgttttaaaaaagaacttttaaactataaaggcagtatgttcattggaagacatatttaaaatattaaaaatattcattaattaaaatcagaagacatattcaccaaagatgaacacttttaatattttgatttgttttctacaaattatttttctgtaagttattcttatgtgtttatacatgtatgcagatctactaacactgtctaacatgcatattccaaaattatttataactgatctaattttaattttcagattgagttacagggaaacaaatatccagtaaattaatttctactttataatgcaatgttaatactctttacaaataacagattcctatgtgctatcctatattttaaatttcttatctttctacagtgttatttgtatatatccccttatgacactggggggcagcactgactggggacagtggaataagctgctcacactgtccagagatgagtttgctttgttctttgaggacaatcagatgtccccccaaaaggcctttccttttgacaaactctatgaagaattacacctatcttcctaggataagagaccttcttggtcacttttgtgtcacatagacactgtgagtggcaaggaaatgctcactctgctttgttattgctgcctacctacatacacttccatcccaaatgtttgtgaagtgatctcactgaactataacccaagtggaacaaaagctttgctgtaacttattcttctactatccactattgaatatgcttgcttctttatattgtggtccagagaggtaagtttctagcactgcctatttttcttacttctgtccagtaaaactgggaaagaaaataaaagctttaccttttctattcctttctaggcaggacctttaaagccaagatcttctcccagatcaagtagatgttctggtgctttgcttttgaattgcagtaagtggaagaagtatatagggaaacaggcaacttactaaagaaccaagcgattctgccagtgtgcatcccgtaaatacagagagctgcatacttttccacaatgattaatattgacctttgaaatttactactaccctgaaactcaccccacagatactggtttcttttatttgtgatactgttactgtgcactaaaataaacaaacaaacaaaaaacccaggaacataaaaaatacttttaaagcttgcagtgggggcattctcctgtaattccagcactgggaaggtggatatctgcaggtggatcaggagttcaaggccagctttagctatataaggcatttaccaacagcttgggctatgtgagacacttgtaaaaaccaacaaacaaacatgaggaatgtgggtgactctcctgatgttttgcagagaatgcctagtgcctagcagcttcctatggccttttcggttgtccctatgtgctagaatggttaatgtgcttcgtctggatttaccctgatagcaggccaggaccccattgctacaacttttatgttagggtcctctttcaaaggtatgtaaggaatgcacctagggtttatcaaggcttcttcagttctcactgcagagacagataatacataccacagagaatagaatgaatccataagtgttagaacacaatggagactttggtctttgtatgctttggtggaatatttaaagaagtagggggttgttgtagattggatactggcaaaagtaggaaccatttattagtactagctcaataaacattaatcatggtatatcttggaaaactagaaaagtgataaagctgtatttggtaaaatagttgtagcctggctggctatattgctcagcagggaaaggcgcctgacactgagcctgattacctgtgtttgattctcagaacctacataggcagggagataatgcactcttgcaagttgtgctctgacctccacagatgcatgtgtgtgcacaatgtaaaaagaaaaaagatgcacacattttagcttctgtattggagtatttgatattaagaagagttacatagtagtcttttattttggaccttcttagataaattaagtggactagctttgcctcattttaatacatttcccaagtaaccttatataaggttattattatataaaatgaattatgcccaacaagagactaacacggcctacctgtatgaaccagctcagattctcgatatcagggattgcttttcattttccctttgctttcatctttatcccaggaaacagtttgaggctctaattactcccctaggttgatttatctttagtgttagggtcttttaggtcttgaggttagtctatcaatctcaggccaccacatagtcctgtactagagtttaggtcccaactatgttaaaaataatgatttggaggcagaagagatggctcatcaagtaacactgttgcagaggacccaggttctgttcccaacccccatgtcaggcaattctcagctgtctccagtttcaggggatctggcatcctcatctgatttccatgggcacctgcacttatacatacccacacatagacacaaattatatatattgtatatatataatttcactttaattctttttatactttcatttatctatttaccctctttacatcctgatcacagcccccctcttctctcagtctcacctcacacctcctccacacctcctcccccattccctcctccccttctctagtcacagcaggactaaatgtatcctctcccactgaggctagtcaaggcagcccagctaggggaaggggatccaaaggcagtaaacagagtcctgatccaattgttaggggaactacatgaagaccaagctgcacaccaaaaaagaaaaaaaacccaagggtggatccttgaatctcactcagaaggggacataaaatagacattggaagtgatgagggagggaactggatgggagaagaggtgaggaggggaacggggtggggggtggggttcaagtgtggggagaacaggatgggggtgagagggctgggagagagaacagaaattgagagggcatctctggaacaagccaaagacctatacttgcatttttaaaataaattattcatgtgattttggactctagaaggttatttgaggtaactgctagaaaagacttctgagaatttttatcttcctagggaatagcctgaaacacacacacacacacacacacacacacacacacacacacacacacacacacacaaattcccttttaaatacatgataataaaaaaataaggtatttggtattatatattagagggactagtctttaggaccaggctatctgaattccaatcccaacccctgtaacaatgtataattttgactataaatactatacgaatctatctttgctattttattaatattcatatttgtgaaagattcaaaactacacattattaaattactaattaataacaattattaccctaattactttccaatgtaaatgaagtgacagtttacactttatatttcaagaagtctccaagatatttgatctgcaaatactaagatagtcaagttgagtagcagtactttaattattcacaagatcagtatatattagttacttttctgttgttgagacaatacgccacattctgaagcaatttatgaaacataaaggtggatatgattctatcatggtggggtaccacagaagcaaatagcagacatgacagcagaaacagaaagtgaagggattacatattcaactgcaaacagtaagcagagagatataactggaagtgaaactatgctataaactttgcaggccccttctaataatttccttccttcaggagggctacacttccctataactgcccaaaacacggccaccaattggggaccaggttttcaaatacctgagtctatggaggacatttctcattcaaaccaccacacctggctcataaaaaggatcataaagtcagttactattgaggtatttccacattgccaagtatattcatagtttttgatttgtgtatactaagcccagtatttatttgaggccttttgttcagtgacttctgtggtttgaataagaatggtcccaataggctcacatatttgaatgcttcgtcatcagggagtggcactacttgtgaagaattaggagtattctgtccttctgggagtatatgtggtcttgttagaggaagtgtgtccctgggttgaggtttcaaaggcccaagccaggtccagtttctcacttttcctgttgcttgcagatccagataaggaactctcagctatttcttcagcatcacggctgcccacatgccaccatgcttcccaccatgatgataatggattaaacccctgacactataagcaagtcccagttacatgctttcttttgtaagagttgccttggtcatggtgtctcttcacagcagtaaaagagtgactaagacagtgactaacaaatatatcatgaatctgattttaaatatgtggtaaccagagacaaatagaatagagaaagtaaaaattatgtgaaattatatgcaatctataggtatataacatttaagctttcagttagcatataaatatgtatgatatgaggtatgctatttataaaacagaaaatattttaaaaagaaacagaacatatctgtgagatatattttcttcagattacttgcccaatgacacattttaaaactagaaaggaatgtttaaatgaagcagtttctgtctgccatttaaaataaacactattaattatctgctggtttatctattctatgtgttcaaagacaataaaaatgaaattcaagccgactatatgtaacctacttcctccatagtcttcttgctcatatactgtcacacccccactgactctgcatgtgtgggtttttgtgtgtctgcccatttctctgtgtgtgcacagatacagctgaggtggatcatgaagtacaataagaatgtgtgaggaagggcatggccattctccataaaggatcccaggcttctatggctttgctgttttaggaatatgaagactagttgagcctaacttttggtctttgacagtgaaggcatggaagcatgtcttcgagatactccattgagtggtgtgggagcacatgcatgcaagccaaaaggaatgggtgaagcatcactgttcaggcccatggctttatgaactcatgatttatgtgtaaggatacatgtggtctgtggttggtgagaaacaaagatagtcctggtgtaagcaggtgccttaagtgcctttgcagaagttgggaaatgtttacatgttttttttccactttgaagtctaaattcttctcttgtgcccacctaagtgatcataggtagtgtaaagaaagattgatgatcattttttttggcttttttggctaagctgaagtagaaaagttcaggtggcaatctagagggaaacaacaacttaagtggagtgtcttaggaatgggcaatgagggaggctttcgagtagtttagctttgatgtaactaaggtcttaagtacccacagaataagtattcttctgatgaatgaaatatgattgtgccttggtcttaggacagaatggaagctcaggtgtgcagcacgaatgtgcatatacagaagaaatggtacataaaaagggttactgcttgtgacaccggtagagcacgtccatgtagtcctcctatagatacatttagaagactagatagtacatgattattacataatctgcagggcacaaaacatattccaatactaattttgtgtttttgaagaaactgaggtcacttttcctgttttcttagagctctgtcaaaagcactcagaattctccttgtgcgatttcactcttgtactgtgttttgacaacagtttgtaactgagggaattcagggcgggaactcaatcaagagctgaagaactggctcaccttctggattgtactctggatcatgattagctaggcttcttacatgatccaggcctacttgcctagggggtggtgctgccaactgtgggttggcctctctcacatcagtcactggccaagatgctcaacctgatgcattcaactccgcagctgagatgccattagaggactctatagactgtttcagctgacagctgcagatactacctaggactccttgtcacttgtcaacctgacacaaaaacacggcctttcaattgttgtttccaagatctctcgtaaagatcaaaatataaaacacaattcaatttttagatttgaattttatgcttaagcttttgacttgcatttatgcctatgtcccacatgcatgctcaagtgtgacggttgtgaaccactatgtgggtgctgggaactgatcccaggtcctctggaagaacaagtgctcttgacacctaagccatccccctagtctccaacaggccaaattttataagttccacaatctaaaaattttaatattttaaaagtccaaggtctgtttaaatatccaaagtctcttaattgtggaatactgtaaaataaaaacaagatgttacagaatttattattacaaaatggaaaaaaaatcagtgtgtagttacaacgacgtcaaagcaactctcaaaatccagtagtgtcaatcaaatactttacttcagtatctcatatctggaaatcactcatggtcatctgggctccaagtcactacagttacttgtgctctgctatctgcagcacatataacttgtttcaaacataagttcaggttggctctattccacactccccccaccccacccccaccatcctggtgagcaacccatgttcctggcatctccaatatcctgggatctctttactgttaactgatgcttcacttcaccagtggtcactcaggatgtctctacggtgattccaactctgccacaaagtgccaagcctctgctgttctctatgactccttcatgccttcaaaaccaatacaatatggtgaccttacccattatttgccaaattttctgttggtttgttgtataccccatctcccttatgctgaccctgagaaaatactgctcagatttcatcttaacgatgctgacctcctaccaaccacagctgattcttactcaaatggccctgctgaaagagtcattgcttccttttgaaaaatttcaaaacaggcttgcctaataagagtgttaagagaaatgcagattatggaggcctggtttaaaaacaactctgagtacttaccagcttttcgacttcaaagttctgaaacgttccacaatcttccccattgaacaacatggtcatgtccactatggcaacactacactcccaggaacaatttctgttctagtttcattctgttgctgtgataaaccactcatacaaaagggaacctacagaaaggaagcttaagcttacaagaacaagtctgtcaacagaggatgtcaggacagcagctcaagcaaaaattgaggcagaaactatgaaagtacactgttcactgactcactctctgaactgcattctagcttagtccttaattcatgctcaggtagactttatacatcccatgaccacctgactagatgatgccacccacccactgtgagctgagccttcccatatcaatcaccaatcaagacaatctctcacagacatggccacaggccaatctgatctaatcaatccctcactgttgcggccgccagcagctcgcaacgtgaacggttcgactgatatggctactcgagctgtaagagaggaatctagacggggcgaaagaagaaacagagctaagacaaattcattctgatcaaagctcaaattttattgttgcgacactagttatgaaggaagggggaggggacccgattcctgccgaataatctctggtccagtagaaaggtgagcacgtgtgtggctcagaacagcaaagcggcaggttccagcagtgggcgtggcagaacgaatgagcaggaagctccacccctgagcaagcaggtttcaggctgggggaggggagactacacctcacttgataccctcctcagtgacttaggttgtgttaacttgatagctaaaattaatcagtacaagtaactgcgttttcattaaatttcctatttcaaacttaacatgctttcataaatcacattctttatcacccccaccccatacacacatacaggcctggatgatggagaatgagaagctcaaaggttgtcagaagaagccaatatcaatgagcactcagtgtacacagaagtgataaaatgtgatgttttgtatatgtgtacatgcctgcctctgcgtgaatgtgcttatttcgttgaaggattcaccagtaataagtgcaagtatttggataattttttttctattctaaatattacctagatgttgccaagaatcctacggataagggaagaatcagtaatctatgacgccattccttactacgacaaggtgctttttattgcacatattagaagaactgaatagtttttctttgctaagacccatattagccaatccagtttgtttacatttcatgtccaagcattacacttccatgttctcactataaattaatatggtgtttgtagaccattccagtgctagaatggatatgtataggattggcccactttaattctttctcatatgtatattattttttactggcaacatctattaagattgtttcccctacatttagcagttatggaaacttcgtaaaaatcatttgacgagggctggagagatggctcagtggttaagaacactgactgctctttcaaaggtcctgagttcaaatcccaccatccacatggtgtctcacaaccatccataatgaggagatctgacaccctcttctggtgcatctgaagacagctagtgtacttacatataataaataaaaaacctttagcaagtggggctgacaggagtgaacggggctgaacagaattcaaattcccagcaaccacatgatggctcacaaccatcagtgcagcttcagtgcactcatatacattaaacaaacaaacaaacaaacaaacaaacaaacaaacaactctttaaaaaaatcatttgaccacatatgtgcagggatttttttttctggtctctatattctactccatttgtctatgagcctgtctttatgctagactcatgtcgattcatttattgcaactttaagtcgatttttattttcaaacttactaccctatttaggggtcctttgagatttcatgtgaattttttagggtatttttctatttctttttttcttttgtttttgtttttcgaaacagggtttctctgtatagtcttgattgtcctggaattcactttgtagaccaggccgccatcaaactcagaaatcctcctgcctctgcctcctaagagctgggattaaaggcgtgcgccaccatgcccggccttttttttttttttttgttttttgttttttgtttttttattagatattttctttatatacatttcaaacttcaaatgctatcccgaaagttccccatactctcccccctcagccccctacccacccactcccacttcttggccctggccttcccctgaactgaggcatataaagtttgcaagaccaatgggcctctcttcccagtgatggcctactaggctatattctgatacatatgcagctagagacatgagctctggggaggggggtactggttagttcatattgttgttccacctatagagttgcagttccctttagctccttgggtactttctctagctcctccattgggggccctgtgatccatccaatagctgactgtgagcatccacttctgtgtttgctaggccccggcataaccacacaagagacagctatatcagggtcctttcagcaaaatcttgctagtgtatgcaacggtgtcagcgtttggaagctgattatggggtggatccccgggtatggcagtctctagatggtccatcctttagtctcagctccaaactttgtctctgtaactccttccatgggtgttttgttcccaatactaagaaggggcaaagtgtccacactttggtcttcattcttcttcagtttcatgtgttttgcaaattgtatcttgtatcttgggtattcaaagtttctgggctaatatccacttaccggtgagtacatatcatgtgagttcttttgtgattgggttacctctctcaggatgatgccctccaggtccatccatttgaataggaatttcataacttcattcttttaatagcctagtagtactccattgtgtaaatgtatcacattttctgtatccattcctctgttgagggacatctgggttctttccagcttctggctattataaataaggctgctatgaacatagtggagcatgtgtccttcttaccagttggaacatcttctggatatatgcccaggagaggtattgcaggatcctccggtagtactatgtcaaattttctgaggaaccgccagactgatttccagagtggtgatacaagcttgcaatcccaccaacaatgcaggagtgtccctctttctccacatcctcgccagcatttgctgtcacctgagtttttgatcttagccattctgactggtgtgaggtggaatctcagggttgttttgatttgcatttccctgatgattaaggatgctgaacatttttttcaggtgcttctcagccattcggtattcctcaggtgagaattctttgtttaactctgagccccattttttaatggggttatttgattttctgaagtccaccttcttgagttctttatatatgttggacattagtcccctatctgatttaagataggtaaagatccttttccaatctgttggtggcctttttgtcttattgacagtgtcttttgccttacagaagctttgtaattttatgaggtcccatttgttaattctcgattttacagcacaagccattgctgttctattcaggaatttcccccctgtgcccatatcttcgaggctttcccccactttctcctctataagtttcagtgtctctggttttatgtggagttccttgatccacttagatttgaccttagtacaaggaaataggaatggatcaatttgcattcttctacatgataactgccagttgtgccagcaccatttgttgaaaatgctgtcttttttccctggatggttttagctcccttgtcaaagatcaagtgaccataggtgtgtgggttcatttctgggtcttcaattctattctattggtctacttgtctgtcactataccagtaccatgcaatttttgtcacaattgctatgtagtacagctttacgtcaggcatggtgattccaccagaggttcttttatccttgagaagagttttttgctatcctaggtttttttttattccagatgaatttgcagattgctctttctaattcgttgaagaattgagttggaattttgatggggattgcattgaatctgtagattgcttttggcaagatagccatttttacaatgttgatcctgccaatccatgagcatgggagatatttccatcttctgagatcttctttaatttctttcttcagagacttgaagttcttatcatagagttctttcacttccttagttagagtcactccaaggtattttatattatttgtgattattgtgaagggtgttgtttccctaatttctttctcagcctgtttatcatttgtgtagagaaaggccattgacttgtttgagttaagtttatatccagctacttcactgaagctgtttatcaggtttaggagttctctggtggagtttttagggtcacttatatatattatcatatcatcaacaaaaggtgatattttgagttcttcctttccaatttgtatccccttgatctccttttgttgtcgaattgctctggcaaggacttcaagtactatgttgaataggtatggagaacgtgggcagccttgtctagtccctgattttagtgggattgcttctagcttctcaccatttacttttatgttggctactggtttgctgtagattgcttttatcatgtttaggtatgggccttgaattcctgatctttccaagacttttatcatgaatgggtggtggatttttgtcaaattctttctcctcatctaaggagatgatcatgtgttttttgtctttgagtttgtttatatagtggattacattgatggatttccatatattaaaccatccctgcatccctggaatgaaacctacttggtcaggatggatgattgttttgatgtgttcttggattcggttagtgagaattttattgagtatttttttatcgatattcataagggaaattggtctgaagttctctatctttgttgggtctttctgtggtttaggtatcagagtaattgtggcttcatagaatgaattgggtagagtaccctttgcttctattttgtggaatagtttgggaagaactggaattagatcttctttgaaggtttgatagaactctgcactaaacccatgtggtcctgggctttttttggttgggagactattaatgactgcttccatttctttaggggatataggactgtttagataattaacttgatcctgatttaactttggtatgtgatgtctgtctagaaaaatttccatttcatccaggttttccagttttgttgagtatagctttttgtagaaggatctgatggtattttgaatttctttaggatctgttgttatgtctcccttttcctttcggattttgtaattagtgtgctgtccctgtgccctctagtgagtctggataagggtttatctatcttgtttttttttcaaagatccagctcacatttggtttattctttgaatagttctccttgtttccacttggttgattcgcccctgagtttgattatttcctgctgtctactcctcttgggtgaatttgctttcttttgttctagagcttttaggtgtgttgtcaagctgctagtgtgtgctctctctagtttctttttggaggcacccaaagctatgagttttcctcttagaaatgctttcattgtgtcccataagtttgggtatgttgtggcttcatttcattaagctctaaaaagtctttaatttttttctttattccttccttgaccaaggtatcattgagaagagtgttgttcagtttccatgtgaatgttggctttctattatttatgttgttattgaagatcagccttagtccatggtgatctaataggatgcatgggacaatttcaatatttttgtatcctttgaggcctgttttgtgaccaattatatggtcaattttagagaaggtaccatgaggtgctgagaagaaggcatgtccttttgttttaggataaaatgttctgtagatatttgttaaatccatttgttttataacttctgttagtttcactctgtccctgtttagtttctgtttccacaatctgtccattgatgaaagtggtgtgttgaagtttcccactcttattgtgtgaggtgcaatgtgtgctttgagctttactaaagtgtctttttttccattttttattaggtatttagctcatttacatttccaatgctataccaaaagtcccccatacccacccacccccactcccctacccacccaccccccccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccagcatagtctcacaagagacagctacatctgggtcctttcgataaaatcttgctagtgtatgcaatggtgtcagcgtttggaagctgattataggatggatccctggatatggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatctgatatcttgggtatcctaggttttgggctaatatccacttatcagtgagtacatattgtgtgaattcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctctggtagtactatgtccagttttctgaggaacctccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccatcttttaagggggctatttgattttctggagtccaccctcttgagttctttatatatattggatattagtcccctatctgatttaagatatgtaaagatcctttcccaatctgttggtggtctttttgtcttattgacggtgtcttttgccttgcagaagctttgcagtttcacgaggtcccatttgtcaatcctcgatcttacagcacaaaccattgctgttctattcaggaattttttccctgtgcccatatcttcaaggcttttccccactttctcctctataagtttcagtttctctggttttatgtgaagttccttgatccacttagatttgaccttagtacaaggagataagtatggatcgattcgcattcttctacatgataacaaccagttgtgccagcaccatttgttgaaaatgctgtctttcttccactggatggatttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttattcttgagaagagttttttgctatcctaggttttttgttattccagatgaatttgcaaattgctccttctaattcgttgaagaattgagttggaattttgatggggattgcattgaatctgtagattgcctttggcaagatagccatttttacaatgttgatcctgccaatccatgagcatgggagatctttccatcttctgagtactaaagtgtccttaatgaatgtggctgcccttgcatttggggcatagatattcagaattgagagttcctcttggaggattttacctgtgatgagtatgaagtgtccctccttgtcttttttgataattttgggttggacgtcgattttattagatattagaatggctaccccagcttgtttcttcagaccatttgcttggaaaattgttttctagcctttcattctgaggtagtgtctgtgttttcccctgagatcagtttcctgtaagcagcaaaatgttctgtcctgtttgtgtagccagtctgttagtctatgtctttttatgggggaattgagtccattgatattaagagatattaaggaaaagtaattgttgcttcctattattttcgttgttagagtttgcattctgttcttgtcgctgtctttttttaggtttgttgaaggattactttcttgctttttctagggcgtggtttctctccttgtattgtttttttttctgttattatcctttgaagtgctggattcgtggaaagataatgtgtgaatttggttttgtcgtggaatactttggtttctccatctatggtaattgaaagtttttttgggtatagtagccttggctgacatttgtgttctcttagtgtctgtataaaatctgtccaggctcttctggctttcatattctctggtgaaaattcttgtgtaattctaataggcctgcctttatatgttacttgacctttttcccttactgcttttaatattccatctttatttagtgcatttgttgttctgattattatgtttcgggaggaatttcttttctggtccagtctatttggagttctgtaggcttcttgtatgttcatgggcatctctttctttaggtttggaaagttttcttctataattttgttgaagatatttgctggccctttaagttgaaaattttcattctcatctactcctattatctgtagttttggtcttctcattgtgtcctggatttcctggatgttttcagttcggatctttttgcattttgcattttcttttattgttgtgccgatgttctctatggaatcttctgtacctgagattctctcttccatctcttgtattctgttgctgatacttgcatctatggtcccagatttcttttctacggtttctatatccagctttgcctcactttgggttttctttatagtttctacttccctttttaggtctagtatggttttgttcatttccattacctgtttggatgtgttttcctgtttttctttaaggacttgtaactctttagcagtgttcttctgtatttctttaattgagttattaaagtccttcttgatgtcctctaccatcatcatgggatatgcttttaaatctgaatctagcttttcagctggtgttggggtgcccaggactgggtgaggtgggagtgctgcgttttgatgatggtgagtggtcttggtttctgttagtaagattcttatgtttgccttttgccatctggtaatctctggagttaattgttatagttgtctctggttagagcttgttcctctcgtcattctgttagcctctatcagcagacctgggagactagctctctcctgagtttcagtggtcagagcactttctgcaggcaagctctcttcttgcagggaaggtgcacagatatctggtgttcagacctgcctccttgcagaagatgaaggcccgaaacagggcctgacccagaagctgtgtcatttcagcctgtcccagggacgctgttagcttctgtagtccacactctcacctatgcagactagtctcggagggatccgggaaccaagatgcttcccccaggtgctctggcaaagccctcctgggcagggcggacacctctcctctggcagggaaggtgccagatgtctgaagcctgaaatggggtctgcctcagatgctgtactctagggaccttgggggtgtctgctgactctgcacccaaggtgaccaggtgctggcgccgacccgaagggatttgtgaccctggtcaggcaattggattggaacagaagttgtgttccactcacaggtggtcctaagatcgagtggagagtcctctagggaccttgggggtgtctgccgactctgtgcccaggtgccctggtgctggagtcgactggaagggctttttcttttttcttttttaaagattcatttattataaataagtacactgtagctgtcttcagacacaccagaagagggcatcagatctcattacagatgtttgtgagccaccatgtggctgctggaatttgaactcaggacttctggaagagcagtcagtgcctttaactgccgagccatctctccagatcctatttctttctttcattttcttttttaaaagatttatttatttatttattatttatatatatgagttcactgtagctgtagagatggttgtgagccttcatgtggttgttgggaattaaattgaatttttgtaggaccatgcttgctctggtcggccccacttgctcaggcccaaagatttatttcttatcataaataagtacactgtagctgttttttgacacaccagaagagaacattagatctcattatgggtggttgtgagccaccatttggttgcttggatttgaactcagtacctttggaaaagcagtcagtgctcttatccactgagccacctcatcagcccataattttctatttctacaaaatcatccatgatatttttatagcgattgaatttatttactagattgaatttggtagcactgtcatcttaacaatacaggtgagtttcccccgccccctcgcgtaggacgcggcggcggggcggccccggcccgtctcccggcgcgtcctcaggatgctcgggagctgagcgccgggggcggcggagggtcgcggtctgtccgggccctcgcctcggagcgcagggccaagggagggagtcacgatgtcaggtagccgccaggccggctcgggttccgctgggacgagccccggctcctcggccgcctcctcggtgacttccgcctcctcgtccttatcctcgtctccgtcgccgccgtccgtggcggcctcggcggcgactctggtgtccggcggcgtggctccggccgcgggctccggcggcctcggcggcccggggcggcctgtgctggtggcggccgcggtgtctggcagcgcgagcgccggcggggcggtgtccgcgggccagtcccggctcagctgcgcggccaggcccagcgccggcgttggagggagcagctccagcctcggcagtagcagtaggaagcgacctctgctcgtcccgctttgtaatgggctcctcaactcctacgaggacaaaagcaacgacttcgtctgtcccatctgctttgatatgattgaggaggcatacatgacaaaatgtggccacagcttttgctacaagtgtattcatcagagtttggaggacaataatagatgtcccaagtgtaattatgttgtggacaatattgaccatctctatcctaatttcttggtgaatgaactcattctcaaacagaagcaaagatttgaggaaaagaggttcaaattggaccactcagtgagtagcaccaatgggcataggtggcaaatatttcaagatctactgggaactgatcaagataaccttgatttggccaatgtcaacctcatgttggaattattagtgcagaagaagaaacaactggaagcagaatcacatgcagctcagctacagatccttatggaattcctcaaggttgcaaggagaaataagagagaggacatccggtacagtgatgaatagaagtggtgatagctgggcatcctagtcttgatgctgatctcaaagtgaaatcattcgacgtgtcaccattagcaattggagcagatccagaaggaactaagtgttttggaagaggatattaaaagagtggaagaaatgagtggcctctactctcctgtcagtgaagatagcacagtgcctcaatttgaagctccttctccatcacacagtagcattattgattctacagaatatagccaacctccaggtttcagtgggacctctcagacaaagaaacagccttggtataacagcacattagcatcaagacgaaagcgactcactgctcattttgaagacttagagcagtgttatttttctacaaggatgtctcgtatctcagatgacagtagaactgcaagccagttagatgaatttcaagaatgcttgtccaagtttactcgatacaactcagtaagaccgttggccacattgtcttatgctagtgatctctataatggttccagcatagtttctagtattgagtttgaccgggattgtgactattttgcaattgctggagttacaaagaagattaaagtctatgagtatggcacagtcatccaggatgcagtggatattcattaccctgagaatgaaatgacctgcaattccaaaatcagctgtatcagttggagtagttaccataagaacctgctagccagcagtgattatgaaggcactgttatactatgggatggattcacaggacagaggtcaaaggtctatcaggagcatgaaaaaaggtgttggagtgttgactttaatctgatggatcctaaacttctggcttcaggttctgatgatgcaaaagtgaagctgtggtctaccaatttagacaattctgtggcgagcattgaggcaaaggctaacgtgtgctgtgtgaagttcagcccctcctccaggtaccatctggctttcggctgtgcagatcactgtgtccactactacgaccttcgtaacactaaacagccaataatggtattcaagggacaccgaaaagcagtgtcttatgccaagtttgtgagtggtgaagaaattgtctcagcctcaacagacagccaactaaagctgtggaatgtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataaagagtttcctgaagtcaaactgagtttgatcctcccaaaagccatctgcagctgatgatgagaagaaaaagaaatggcatgtaatgtctctcccaacatcatttggatttgttttaagtaccttttccctcctttatgcctttgggacactgggaatatccagagaattcgccaccatcagtgtaactatgaactttgctgttggcagtgtggctaatttttgtgatagggaaacaaattcttttaaataaaaataataaacaacaacaacaaaaaaaaaacaatacaggttatcgcaggtcatgaatatgggatgtctccatttttattccactgaatttccttcagtcttgttctggaattaatggtgtatatgttttctgctttgttagttaagataattctcaaatattttattttttctaatgttattatgaattgaactgtggaatttttttaatttactttttttgaatctttattgttagtgcatggaaatgcaatgatttgattgtatattgaaactttattgaattctgtaatattttgtgtaacatttagaagttttcatatatattatgccatttatacatttactttttcctttccaatattgaagtcttgaatttcagtttttttgctgattatttttctcatttttaaaattttactttttattactttcccccttttattaaaaatagattcttccctcaaacaatatatcctgattacagtttccctccatctacgcctcccagttcctccccacattcccttccatctggatccacttcccttttgtctctcattagaaaaggacaagcatctaagaggtaacaacaaaacaaacaaaataaaatataagttaaaataaaacctatccctttgaagattgacaaggcaacccaacagaaggaaaagagcccaagtgaagacacaagaatcagtgacccacttattcacactaaggaatagcttatagataaaaatactaaactggaagccataatatatacacagaggacctggtgcagacacatgcaggccctgtgcatgctgcctcagtctctgtgagttcatatgagctttgcttggttgctttagatgaacttgtttccttggtgtcctccatcccatctggcttttacattctttctgcctccttttctgtgggattccctgagccctgagggaagggatttgatggagacattccatttagggctgaagaatatcctcttctgtcactcctcacctattcttttgaggctggatccctcccacacccacggctcacattttctcagctagtctagaagtgagcaagtgcctcaatacttgttctgcttcaatgccaaggttataggtatgcattggatgcccatcttgctgcatgtgggctgagatccaagcttcagtcttcatgtttgctcagtaaaggttcctaacatgactcatctagtccatgaataatattttaatagtcacagaattcaatttgatgaggattttaatgccaacacttttaagggatactgatctaccattttcttttcttgtaatttgtgtttgttgttttgatatctgcttcacactgtctttataaaacaaagaaatgagtttaccgtcctttttggatactgtcccttacgttgtagtccagagtagctttgaatacatgcttttccagcctcaagcctccagagtgcaagatatgtaccaccagatctgggacttcttcattttctaggagttttcctcttaaatgtttggtagcatgcatatgaagacatctgtactggctagtttttattaacttgacacaaaccggagtcacttgggaagagagaatctcagctgaggaattacctctatgatattggtctgttggtatgtctgtggggccattttcttaacaaatgattgatgtaggaagtcattgaagtaggattgatgcgttgttagttgtggcatccctgagcagatgggcctgcactgtattagaaaggtagttgaggccccaacctagtatgcctacccctgatggtgctacttccaacttctaggctccaggcaatatgtacatcacctgcccacaacctacagggtccttttatgctacacacaacctctgcccagtcagaatcttcacatcttgaactaaggtctatccaattgagcctgcctgatctgcctgagagtgccttccactctctccatacttagcctgggtcccatgtccagtgttggcacctaatctggccactgatactttgtgctactccccaacttccaggctttagacatgactcacactttcaaatcacaatcaacaagccacttgcaagtcacattcaacttttctgtccaggcaggtcctgtaaatcatgtgccatggcctaacgtggagaatatgcttaatcttcccactataaaacctctccaaatcccaagatctagcctggatctcacgcttaataccccagcttcatatggccacccctacttgcattgtctgcaacttacagggttttggccactacttatgctgtcttactgtagtctaaagaccccttgcatgcccatccaaccactcagccaagctaggtcctgtacaccttgtgccaggatctaggcaggtgattccacccgattcttgtggggctgtgggtgtaggggaagaggggagagggagagagcccacgtccagccagagttcttgtgctctgggcaggcagacatgggaggactgtcggacgttttccacgtggccctgggtgagcatctggctgtgtgaagccactgaacccacatggcgggggttggaggaggggcagtccccagtaccaggttctcagtctctggcatcgtatgctggatacagcagaggagctgagaacagaataggggccccagggtagcactagaccctggagatacgggaagagggggcaggggggaagaggagggggtgctgggtggttcccatgcaggcaagcgggagtccttagtctggtttgtggctggagtgtaggaaggccttctgacaggaggttagatgtggctcgctagaagaaagcctaccccattgttcaagcacagtgggccttgatgaacagaaacagtctatggttttagagctttattttagaaaggcatggggaaagagagaaggtagaaagagagagactggccatggtcatgtggaggggggggagagaaaagagctagagaatttaaaaggtgaaagcttaagagagaggtaaaagctgagagagagagagagagagagagagagagagagagagagagagagagctagcttagagagtgaggaggggccaagcagcccctcttatagtaggcttgttatcttgctgttgctaggtaactgtggaggagtctagccagaaggccagaagcttgggacattgtgtacgtgactgctagccatgagcctcttctgtgggggctgtgggggctgtgggggctgtgggggctttgggggctgtgggggctgtgggggctgtgggggctgtgggggctgtgggggctgtagaggcagtaactatgacaggagctaggagtccaggagtcatgaggtgactgtcccatgtagatgaaaattaccacccatcgggtttcactggggtttaagacctcagcttgactggagagcagactgtctgtgcatagcccattgccccacagattctccctttcatgcaccttctcaaaactccagatctacctccagtctccatgcttggaccaggatgcacattctgcacacaaacccagcctcttttctgcctgacttcattctatcttagccatattacagctttcaggttcatcctggcccacagatcctgtgatctggttcagcctggtatgtttacttcagacctaataaaagaataataatagaatcaataaaagaagtgcttttggccacattgcatttcaaaaatataagcaatatgaaagattgagtcagtatttgcccaccctaacccagcagtcctatagaaatattctctaatgggagttacttagatgaaacctatgatgtagatttttttttgtttttttctaacatagtattttttattgattatttaggaatttcacacagcacaccccaattacacttgcttatcattcgtcccaggtccaccctccccttctcatgccctttctgtcaaaagaaaaaaatataccaagtctaatttgcattgcccatatactcactgcagcatggtcaaatgctgagtgaccagctccttaaagataactgtgtccttcccaacccaccagaagccatcaacaatgaagaacttcacttcagcatctttaccacatttttaaaggactctcttcaaaagctttctatctggtctctctctctctctctctctctctctctctctctctctctctctccctctctctctctccctccctctctctctctctctggtggcatgttgtcacagaagccttcaatgtctcttgttttcaattatgactgtacagtcatgagcaccactgcaagagaagcttccttgctcataacagtcagcagcagcatagaccatggatttccacatggtttccagtggcagcacagaccatggacttcaacatggcttctagcagtaacatggactgcagatatccacatgacctccagtatcagcatggattatagacccccaacagccttgatcacagacataaagatggtttctggtggcaacacagacaagggacttcaagatagccttcagtggtgacagggactatgacatcaacatggcctccagaggggagcacagactacagacatgaacatagcctctggcaagtaacatgtaccacaaacattaacatgatttcagtaggcaacctacaccacagataccaacatatcatctggcagtaacaaagaccatgaacatcaatgtggtctcaggcagcattacagaccatgggcatccacatggcttctggaaacaaactgtacattggaaatcaacacaatcaacatggactgagttgccagcacagatcactgacaccagcatggcctcttgccacagcacggaccatggaggtcttttgaggagtcataaaccagaaaatgaatcaatttttccttttggatgtcttgttgttgcctaattagagccagggcaattgtgtgactggacaatgcatttagggacaaaacctatgtgagcttcaggctcctgcacaccaccctgaaggccctactcagtaataacatgcttatttcccttgtgcaactgtgatcctatacttgtcagtttccccaaggcatcttttagttctgcctctctcctctgcacacttaccctacatcctgccatcattcttacctctccattgaacattcatccttcaaagcaggataacaaactattgtatatatgtatatatctcccacacaattttataagcaaatatttattagaataagtcattggtctggttcaagatttctggtttctaaagcactataagtactagactattgttgagattcatctagaataacctcttgttgcccaaggtcagggtaatcttgtggctgggcagtacatctagggcaagatctgtatgaggtccaggctgctacatacctctcttccctcagtgctgactgcctgattaactagcccagtatgaccattatgcttatagtctgtggggagtgccattggctccctgctcttctcccccagcaaagtgagctgtgtaagctgcaacaacagtggttccatgtagctcctggtgggctgaggaccagccctacttagcaatgacaagctcctttgtctgcagtagtcccatacccattgctactgcaacatctctggtttttgccactctgtcaagcacatggctccactctgccatctttctttccaatttcatgagagcactttttaaagcatcttcccataagacttgccttttttagttgttcatgtgatactgtacattctgcagactcatcttctgctttgtatctctttgaagcctccatgggttttttaggctccttacagctgttccaacatcccttgggtgttgacagctgctgccatcttgaatcccaggatgcagaatttaaaagaacaacaaatactttatcaaaaaggtcaaggaatttaagaagatgcaaagacatagctcagtgaacttaaacagatttaatttaaaaagaaaaaaataacttctgagtgattcccaagaaaatacaaacctaaagctgatagaaatgacatgacagagacaatccaggacttgaaaacagaattcaacaaagaagaaatactgaagaaaactcaagctgaaattaagatggaattgaaaaaacaaacaaacataaaaacataataatccaactagaaaactccagggaaagtgttatgtctaaaaaaaaccaagatgtttttctgtctctgatccctggaagatttgttcccaggaagcctgaaaaaaggacaacataaaccccatttgtccccatttaaggaccaagcttgattttgaaaagaagtccataaggcaccagatccaggaacaaaccattagtcccaggatctaggtcataaggcactatccccaggaacagaccaataaatccagaaacaaggccataaaacccccctcccaaagaacagcctggggataaccacaagaatgggaaaatatcttatctcagaacaggccatctgctctgggtaaccctatgtcattctatggttaaacattcatgacacaggaatgcagaccactgaccacttgtgaccccctagcatccaccaatgaaattttagattacctaatacttctagacatttacctcaggtccctataagaaagccttcatgcctttgtctggggttgacagtttttttgcgtctgtaacatgcttacacagatacccaaagattgttttgagttgccttaatcacttagcttagcagaacagagcagttttacttgcttacattgatatctaaggtctttgtgtggttttgcctttaaaagtccttcccaggggtcacaaacgccataacaaaagcctaacaagcagaataatttaaacagaagatagaatatcagggcttaaaaatagagaactagaccaactaggcaaataatgtgaaaaagggaaaagaaacacacaaaaaaggaatgtgcataaaatgtggaacatcacaaaaaggccaaacctttgagtcataagactagaagagaatgaagaacccccaagtcaatgaggtcatagaagaaaatttacacaaattaaggaaacacacatatagataaaagaagcattcatgctccattctccctttacctctcctccacctccatcagactcccgaaccctacagataagcttcccttccccctctcatctaccctgatctctgagccctctgtgccaagccaagctgctctgagcagcctgctatcccagggggaccaccattcttccaccacctctcctccacttccatcagactgctgaatcatacaggtaagcttccctttccccatccacaagtcctgttctctgaaccctctgggccaagccaaacttgctgagcagcctgctatctcagggggatctccattcttctgccacatcaacccccacctccatcagacctgagactcctaaaacatacagaaccacaggtctggaaccatacaccccaaggatatccatcctttgaatatgctacaccaggaccatcaaggttaacctccctcccaatacttactacaacaagaacatccagggaccaaaaccatccagatggctaaaatccctcaaaaatatacaataaacaagagccagggcaatatgacacccccaaagcacagctactctactacagcaagccctggatatcctaacacaactgaaacacaggaaaattaccttaaatccaatattataaagatgatagaggcctttaaagagaaaatgaacaactcccttcaagaaatacaggagaatacaatacaattaaggaggaaacaaattagtcccataaagatatataggaaaatacaattaaacaggtgaagaaaataaatagaactgtgtgagacctgaaagtagaaatagaagcaataaggaaaacacaaactgaggaaatcctgaagatggaaaaacctaaggaagacaacaggaacaacagaagcaaggatcaccagcagaatacaggagatggaagaaagaatctcaagcatagaagctacaaagcgggcatagatacatcaatcaaagaaaacattaaaactaaaaaattcctgacacaaaatatctgggctaccataaaagacctaacctaagaataataggaatagaagaaggtgaagagtctcacttccaaggtccagaaaatattctcaataaaatcatagaagaaaactttcccaacctaaagaaagatatgcctataaacatacaggaagcttatagaacaccaattagactggcccagaaatgaaactccacctggcgcataataatcaaaacgcaaaatctacagaacaaagaatattaaaagaggtaaaggaaaaatgtcaggtaacatacaaagacagacctatcagaaacacacctgacttttcaatagagactgtaaaaactagaaaggcctggacagatatcctgcaacctctgaaaaacccacaggtgccaacctagactattataccctagcaatattctcaatcaccatagatggagaaaacaagacatttcaagacaaatccaaattcgagcaatacctatccacaaatctagccctacaaaaaaaaatactagaagtaaaagtccaacccaaaaagaataattacatccaagaaaacacatgaaattatataccagcaaaaccaaggaaatcacacacaagttctctctgcctctgtctctgtctctctctctctcacacaatcacaccccactaacataaaaaaacaggaaataacaatcactggacagtaatatctctcagcatcaatggaatcaattccccaataaaagacaaagtttaacagaatggatgtggtaacaggatacaagaaatacacctcagccataaagatagacattagctcggagtaaggggctggaaaaaagttttccaatcaaatggacccaagaagcaagctggagtagccatcctaatatctaataaaataaactttcaaacaaaattaatcaaaagagacagggaaggacactttatactcaccaaaggaaaaatataccaagatgatatcttaattctgagcatttatgctctaacacaagggcacctacattaagaaacattgctaaagcttaaatcacacattgaactccacacattaatagtgggagacttcaacatcccactctcatcaattgacaggacatccagacaaaaactaaacagagaaacaataaaactaatagacattatgaattaagtgaacctaacagacatgtatagaatatttcacccaaacacaaaagaatataccttcttctcagcacctcctggatccttttccaaaattgaccatatagtcagtcacaaaacaagtctcaacagattaaaaaaaaattgaaataacaccttgcatcttatcagatctccatggattaaagctggactttaacaaacagcagaaacaacagaaaggctacacactcatggaaactgaacaactctctattcactgggtcagggaagaaataaagaacttaacatctttctagaattcaatgaaaataaggatacaacatatccaaactcatgggacactatgagagcagtgctaataggaaaattcataatacataatttagaaagttctcatatcaacaatttaaaagtatacctgaaagcatgactgtcttatgactgcttgtagctgacagaagtatcttttgtcaatgtttaacctgagattctagctagatttggggtgaccaaatgctcagaagcctgaatccacaaccagattatgagtgcctggaaatggagtcagacaccttgaagaacttaatatctttgtttttctttaaggccatgctaacaagaaaactctgtaaatacaggtagatgatctgaatcccttcaaggaaatatcccagggattactggggtcatgcatcctaacaaaagaaaatcaggtttttgtttgagtgtctgaggatttaattctttccagtgtttgagaaagcagtcaagcaatgactttcttggaatccatttgttccatctgcaaccagatagagaaagggagagggaatcttgggtctgggtttttctgtctctactctgattccctagcctacctgaatggccattcatagtctgccatcagggagcagatagtgtggtctgttttttttcccccggggagaggtcagactaggtaattaggatacccaaacattatccatggtccagtcctctgccatctcccaggtttctctttttgtattccaaaattctcaaaaacacctacttagaaggaaagataaagaggccttgggtcaaagttgacctttccctatcctcatttcctagtccacctggatgggtatgtccaatctgtgagcagggagcagctagtatagtctattctacccttggaaaggtcctactaagtagtgggatttccatgccttaccatctgggccatctcttaatgtcctcctttagtaaattacacaagttctgagagaagccagaagttccattcacccatgttccagcctcacataatctagtgatcagacacggaactggagacagtgctggatgcagaaataaagcatgtaggcttcagctcattagcccgttgatacacttagccgaagcccagggcccaaggcttatccatctcattctggagcccatccatctaccaattcagaagttctaatccatatgcagaaatcagccaacaactagaattatagctccaagagggaagaaccagggaacaattgacatcagaaatagcttcttagtgttcagtgtctgggatgcatctgtaattttctgggacctaaagggcctgggaagttacaattctttggctctgctctctataccacctacagctcatatcataggtttaggccagctccactccatagctgctgctctacttggtgcttatatcatagtcctgcaatttcttgcaacttttataccaacaccagtaccacataggtgactcttacatatacaaagttagactgacagcattaaatgcagctttgacccctctggactacagtatttgtgtattgatcctgaagaaatactttccaggtgattcatcgcattgaccctgatctcttattaatcacagctgactcttcagtcccagataaccagtatttattgtccccaaagcaaaactttcactccaggagactcttgtaaaccacagtcgattcttcatacccaactgatagagaaccacagatcacattaacagccctgatatagtatttaagagactctcaaacttctcttggaaccttcagaagccaaatctactatcctatcattagccatggctgacagggagctcacaggtattcatcacatttctatctagtccccagataggcaggctggaggccttttgaagaaacaagttatgtaagcttcatagctgtgacttggtgtgcccttcccccaaccttgagtaggctaaatagacacacaatggttttacaacctagcaggagtctctggcctcaacgcatttgcaatttcctacaggagtagactgcctgtctgagcttgctctgcaacataatccaactgaaacaaaggatggggtctgtgggctttccatatataaacgcagtgatgaaaattaaactttgagccttgatcagaaactttgtcttggcttcatccttctctcgcaccctgttcccttttcatttctagcctccctttcaggtagacccagttcatccatggctgctgaatggctacaacttggccctgaactataacatcacccaaccaaaataggttacatgcaactcatgacttgtccagcaaggtttcagacatgtgctgtgcttgcattcaggccacttctacttgtcatctatttgtgtttcttttttttcccaacataatatttttattgattgattatttgagaatttcacatcatgtaccccaagcacacctacttcctagtcctcaaatgtctgcccccactccccttgtgacaagaagaaggagaaggaggaaaagaggaagaggaggaagaggaggaagaggaggaggaggaggaggaggaaacaaaaaataaaacctaagtccaatttgtgtcgcccatacacacactggagcatggtcaaactcctagtggccagcccctgaaagaaaactgaattgaatctttctccacccacaccccactagaagccatcaattgtggagagctacacttcagcatcagtatcacaattttaaagcgttctcttcagtgttttcctgttcaggctgtttcttttttgggtggggtggggtgtagatagaagttgtcacagaaaccttctcttttacaactgtgagtctgtggtcactgatactactatacaaatagctatctttccctttatcgtcagcaggaccatggatcatggacatccacacggttcccagcaaaagcatggggcatggacatccacatagtcttcttgttaacaaatgccagggacctcaggatgctctctggtggcagtacagcccatagacatcatcatggtcttctgccacagcaagattgtgaaccccaacatggtcctccttggaaggataggccattcacattaacatggcccccaatggcagtccagactatggacatcctcctggcctcctgtggtagcactggccttcgacatccacatggtctccagtggcagcccagaccatggacattgacatgaacctcacgtttcattacagcctggggcagtagatcatgagcaacaccatggccttcaatagaggtctgttggagtggggtgagggaaggggctccaacccattcttcatttccaatatcctgtctttgctcagagccaaggtgattatgcagctggttagtgcatttggaggctgagtctgtccaagctccaatctgctgcacatcaccctgtcaggactatttagtaactacatgttccccattcatcacagccttctctcatacctgccaccaccattacatctctagctccatctttccccatttgtcactctgttcctctctcttgcccacccctctatagcatatttgtttgtcatagcgatgcaggaaacagcagtgtgtcacacagtatatatataattttgcccaaacagctttacattcaagtattcattacaatgagtcacatgcaaatattcattgcaatgagtcactgatctggttcaaggtttcttatttctgaggtagcatagtgggccattgccaaggctcctctcagacatcctgccattgtctggagtcagggtgatattgtgattaagcagggcatctgggggcaggttctgagcaagctcctgattgccacacacctccatctctctatgtctgccactctaaaacttgtctaaaggaccaggcttgacctttgtggttgtagcctgctgactactgcccccattctctgtctcccagcaaagcatgcaaacacaggttgtagctgcagtatttccaagttgggactggcaagtgggcctaggaccagcccaattcattaatgacatgtttctacaggagcttccatctgccagacaacacacacacacacacacacacacacacacacacacacacacacactaccctgtccttggtgcttgctgccccaaggctcatcagacccaactgttgagcttgtaggctgcagggggacaccactgctctgggatttccatctcctagcagggcaagcagcatggttgccccatggttcatcaggcatgacctttgaacttccagcctgctggctgagatgccatttttctttccaatcttacgagttcaattttaaaaagcatcttcccataaagacttgcctttaattttcatgtagttgttctgaaggtactgagggttctgcagattcctttttcaccaccttgtcacccttcagagcctccacaggtctctcagactcctcagagttccacaatgggtgccagcagagccaccatcttggctttcttctacttgctcattttcaacagcatatctactttccctgttacatctcattaacaaccatgaggctaagggttcaaggttgcaacaagtgacacatgcaacataaaaggcagtcacaaagcaggctgattctcaattgggagagatctaaagtcactcctggtagggcacagggaatatttaattggaacaaaagtagtaatagttcccaggatcgtcaggacagaatggttcatggcacaactggtgaatacttgcaaggataatcttgaccactgtcataacaatatcatttgtgctcctggagagctccagaatataacgaccaggccaaggatagtatctgctgtgaaaaaccagcaccaggaatattgaaactagacagcacaaatcccactttactatcagaagtgagatcctagaaggagaatcacccagggtattcaaaacatggcagtctgatgtcagatttccagagcttagtcccttgttcttatggccctatatcagtgaaagggctctgatacactaaatgtacctctctttaccactgggggcttttctcctgaaggtgattcctttattgacatcaattagcagaaactgtgaagtatgtagaaaatacaggaacatttaatggcctattaaactttacccagtaaaaaaaaaaccagttcacctctcacttcccaggtctcttgtacattctagagtgtctccctatctcccaccttccaaggttgcctgtttccattcattctgttggcccctggggctttgctcctgttttccctcaatacctgattatgttccccttttcccttccccctgaaatgcccaacatcagggagggggaacttgtagagttcacctctagtagaaagataggacatcaagtggagggatggggttcccatgccacagtcaaaaactctgacccagaattgttcctgtctaaaaatacctgcagggacaaaaatggagaagagactgggggaaaggaagtccagcaacaggcccagaccgggatccatctcaaggggaagctctaaggcactattactgatactatggtgtgcttacttacagacaggagcctagcatggctgccctccaagaggcccaacaagcagctgactgagacagacacagatacctacacccaaccaatggactgaagtcagagatccctgtggttgaactagggaaaagctggaagaagctgaggaggagggcaaccccataggaagaccagcagtctcaactaacctggatccctgagatctctcacacactgagccaccaacaaggcagcatacatgagctgatcccaggtccttgacacatatacagcagaggactgcctggcttggcctcagtgagagaagatgcaccttgaagccccagggagtggggagggctggtggggtgggatggggtgggggacatcctcttggagacaggggaggaggagtgggataaggaactgttggagggtggaccgagagggggataatgactagactgtaaaaaaaaagtgtaaagataattagaaaggaaggaaggaaggaaggaaggaaggaaggaagaagggagggagggagggaggaaggaaggaaggaaggaaataaataaataaataaataaataaataaataaattcatctaactctcaactcatgccaagagctactcagagttgtgggtactctgttgtaccctaccctattggtttattttcatgttcattatttcccagtagatgagactttttgtcctgcagtttgtatttagaataagacaatgtaagggaaaaaaaccagtcattcgtttcttaagaccaatgggtcaaagagacactatatcaacttgatacacaaactacagttatctaaacagagggaacctcaattgagaacatatctccataagatcttgctgaaagtcattttcttaattattgagtgttgggggagttcccagcctattttgggtagctctatccctggtttggtggtcctgggttctataagaaagcaggctgtataagccaggggaagcaagaaagtaaacaacacctttccatggcctccgtatcagctcctggctccaggaacctgccctgtgtgagttcctgtcctgacttccttcaatgatgaacagaaatatggaaatataaaccagctgtgctttggagagtactttgctctttaacttgctttttggtcatggtattttactacagtaatagaaaccctaactaaatcaagttggtaccaggattgtggggtattgctgtgacagacctgaccatgtttttgggtagcttgtggaaggattttggaactctgggctagagaagccactgagtatcgagagctcaataggatactctgtggaaccttgtaaggtaagaatgttgagcgcagtgaagaagatggaggcctagcttgtgaagtttcagagagagagaggtttaaagctatttttaattgagattatgtcattttggtcagctgtggctgatgagtcagccatgattaacatgagactggcaacattgaagtgaaacctttgcattactgagacaattgatgctggttagttggagctaagaaattaatgatgattgagaaaagaccagcatgattgatgtgaaatcttctagaaagtatttgctcagggtcagaacacacaagcggtgattgatcacagcaatagaaacactacgtaaggcgcttgaggcccactgatagaggaacaaaatttatagaatatatatgggacttattagaatggcttactggctgtgatgcagctagtccaataatggctaaatactaacagaaggtccaagaatccagtagttgtacagtccacaaggctggatgtctcaattggtcttcaatgtatgccagaatccagaagaagtaggctttaatgtcagtgaagaaatgcacttgccaaccagagcaagagaaagtaggcagaaatcaattcttcatccatgtcctttatataggttgtcacaagaggtgtggctcaaataaaaaggcgagtcttcccacctcaaaagattcggattaaaaggggccctttccatttaaaatgatttcgttaaggaaaaaaatccccacagcctatagaggtgagttgtgcatgattccctgaaacctactgtctagctctgggctcactctttcatcctgaggagccttgcaggaccccaagagtgtcctgctctcccatggaaaccttcaatggcaccaaggctaaccagcttggaaccctgctccactactctcattctagttgggtccttctgggatgcagcctgcagaagtgagttgaacacaggccatgaactccattgtctagctctggactcactcttcaggtctgaggagctttgcagggtcccaagagcattctgcagagacccttaagaactaccagcttgggacattgctacactaatcccttgccagtggggcctttgtaaaacacagccatcagagtgaggtaccctgacctccattgtgtgtcccccacacctttctgagaagttctgctgccatcgggatcatccagtcaacaccagggaaaaccagatgcctaaaagacagcataagaacacaatttacaagagccaggccaatatggtaccaccagagtccagctatcctactacagcaaacactggatatcctaatgaaaatgaagcagaagaaaatgatcctaaatccaattttataaagatgacagagacctttaaagaggaaatgaataaattccttaaggaaataaaggaaaatatatccaaacaggtggagagacattagaagaggaggcaaataaaaataaacacaggaaaatgcaatcaaacaggtgaaggatatgtataaaactgtccaagacctgaaactggaatagaagcaataaagaaaacacagattgagggaatcctggagatggaaaactaggaaagagatcaggaactacagacataagcatcaccaacaagaatactaactatgctcaagagaacacaagaaataaataatgttacaccattaaaaccaatataagagaaacacacacacacacacacacacacacgcacacacacacacaaagcaagcctcaacagaaacaagaagattgaaataagttcttgttatcttatcagactaccatagattaaagctgtacttcaacaacagcagtaaaacagaaagcctacatagtcatggaaactgaagaactctctacttaatgatcaatgcatcagggaagaaataaagaaagaaattaaagtttttctagaattcaatgaaaatgaggatacaacatattcaaacttgtggaacactatgagagcagagctaagaggaaagttcacagcactaagtgccctcataaagaaattggagggatctcacgccaatgaattaaaagtacacatgaaggttctagaagaaagaagtaaacacactaaggaagagtagactgtaggaaataatcaaactcagtgtgaaattaatcaattaggaacaaagagaacaatacagagaatcaaaaccaaaagctcattttttgaggaaatcaacaagatagacaaaataactagaggacagagacagtacccaaattaacaaaatcagaaatgaaaagggataaataagagcaaacactgaggaaattcaaagaatcattaggacttacttcaaaagcccgcactccacaaaattggataatctaaatgaaatggatgattttctagacagatatccactgacaaagctaagtcaagatcaggtcaaatatctgaatagtcctataacttgtaaggaaatagaagcagccattaaaactctcccaatcaaaaaagccctgggtcagattattttagtgcagaattctaccagactttcaaagaaaagctagtgacaatactcaaactatttcacaaaatagaaacagaaggaacattgccaaactcattctttgccaaactcattctatgccaaactcattctatgagggcacagtcaccctgtgtggtggtttgaatactcttggtccataggacatggtactgttaggagatgtggccttactggagaaaacatgtgttggggtaggctttgaagctctgctcagtatataagagtcagtcttctgctggctgacttctgatcaaaatgccagaactctctgctccttctctaccaccatgtttgcctggatgctgcaggcacaattgactgaacctctgagcctgcaagccagccccaattaagttgttgtcccttatgagagttgccttggtcactgtgtctcttcacagcaatgcaaaccctaactaagacatgctgatgcctaaaccacataaagacttaacaaagaaagaaaatttcagatcaatttgcctaattaacattgacccaaaaatacttagtaaaatactagcaaactgaatccaaaaatacatcaaagacatcatccactatgattaagtatgcttcatcccagagatgcaggggtggtccaatatatgaaaatctaccattgtaatccaccatataaacaaactggaagaaaaaaattatcacctaactaaatgccaaaaaataatttgacaaaatccaacactccttcatgataaaagtcttggagaaggcagggatacaaaatccatacataaatacaataaaggcaatgtacaccaagtcaatagccaacatcaaattaaatggagagaaacttaaaacaattccactaaagttgggacaagataaagttgtctacttcctatctcttcaatatagtatttgaagttctagccaaagcaataagacaactaaaggagatcgaggggatacaaactagaaaggaagaagtcaaagtatcactattcacagatgatatggtagtatatataggtgacaccaaaaattctaccagagaactacagctgataaacactttcagcaatgtgtctagaaacaaaattaagtaaaaaataatcaatagccttcctttatacaaatgatgataaataggctgagaaagaaatcagaaaaacaactctcttcacaatagccacaaaaaatataaaataacttgttgtaactctaaccaagcaagtaaaagatctgtatgacaagaacttcaagtccttgaagaaagaaattgaagaagatatcagaggatggaaagatctcccatactcatggatcggtaggattaacatagtgaaaatggctatcttaccacaaacaatctacagattcaatataatccccatcaaaattccaacacaattatttttttccttcttttttattattagatattttctttatatacatttcaaatgctatcccgaaagttccctataccatccccatgccctgctcctctacccacccactcccacttcttggccctggcattcccctgtactggggtatataaagtttgcaataccaagggaccgctcttcccagtgatggccaactaggccatcttctgctacatatgcagctagagacacgagctctgggtgtactgattagttcataatgttgttctacctatagtgttgcagaccccttcagctccttaggtgctttctctggcttttccattgggggccctgtgttccatcttataattctttactgacattggcagggcaattctcaacttcatatggaaaaacagaaacaaacaaaaaccctcaaaacaaaataaaacaaacaaccccccaaacaatcctgaacaataaaagaactcctggatgtatcagtattgctgacctcaagctgtactacagagcaatagtgattaatgcatggtattggtacagagacaggcatgttgatcaatgaaatagaatcaaagatccagaaataacaccccacacctatggatactagatttttgacaaggaagccaaaaccatacaatgggaataaaagaaagcatcgtcaacaaatgatgttgttctaaaaggatgtctgcatgtagaagaatgaaaatagatccatacttatcactctgcacaaaactcaaattcaaatggatcaacgacctcagtgtaaaaccagatacactaatctaatagaacagaaagtgggaaataaccttactcattggtacaagagataacttcctgaacagaacactaatggcttaggaactaaggtcaacaatttataaatgggacctcgtgaaattgaaaagtttctgtaaggcaaagggcatggttaataggacaaatgacagcctatagattgggaaatgaccttcaccaatgctacatctgacagagggctaatatccaaaatatatttaaaaaactcaagaagttagacaagatcaaaccaaataacccaactagaaatggggtatgaagctaaacatactgagttgaagcctctacagctagccacacgaccaatggcaccatcttggcatttgttccaggctggcctcacccttcatgttgcaacacctcccggctaggatagatctgcttcaaaagaccactctggtggtgaactaaatgtccatgacttctctggaaaggtagccctttctgaattctacctggtcagataccagggccagataccagggccagagactccctctagtgacatagctggggcagtgttacccattctgttcaagtggtgacactctcctagggcaggggactctgtccagggagccccaaggagcctctggtcagacagagcctcctgtgatcttggggttcttggcttggctgaaactttgtcattgctttgttccagggtggacactaccagggcttactgctcaacttgtttaaatgagggacttcaagactacacagcatggctcttttcagtttattgcatgaaggagttacactagtccaagttaaaagcggaccccaaataattacattatacaagctgtgaggtttttaaacttgtgacaagggaaattctacacacctatggccacttgatcttcgacaagggagctaaaaccatccagtggaagaaagacagcattttcaacaaatggtgctggcacaactggttgttatcatgtagaagaatgcgaatcgatccattcctatctccttgtactaaggtcaaatctaagtggatcaaggaacttcacataaaaccagagacactgaaacttatagaggagaaagtggggaaaagtcttgaagatatgggcacagggaaaaaattcctgaatagaacagcaatggtttgtgctgtaagatcgaggattgaaaaatgggaccttgtgaaactgcaaagcttctgcaaggcaaaagacaccgtcaataagacaaaaagaccaccaacagattgggaaaggatctttacatatcttaaatcagataggggactaatatccaatatatataaagaactcaagagggtggactccagaaaatcaaataaccccattaaaaatggggctcagaattgaacaaagaattttcacccgaggaataccgaatggcagagaagcacctgaaaaaatgttcaacatccttaattatcagggaaatgcaaatcaaaataaccctgagattccaccttacaccagtcagaatggctaagataaaaaaattcaggtgacagcagatgctggcgaggatgtggagaaagaggaacactcctccattgttggtgggattgcaagcttgtacaaccactctggaaatcggtctggcggttccttagaaaattggacatagtactatcggagaatccagcaatacctcttctgggcatatatccagaagatgtcccaaccggtatgaaggacacatgctccactatgtttatagcagccttatttataatagccagaagctgggaagaacccagatgcccctcaacagaggaatggatacagaaaatgtggtacatttacaaaatggagtactactcagctattaaaaaagaacgaatttatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaatggagactgaagtgtggacactgtgccccttcttagaattgggaacaaaacacccatggaaggggttacagagacaaagtttggagctgcgacaaaaggatggaccatctagagactgccttatctagggatccaccccataatcagtttccaaacgctgacaccactgcatacactagcaagattttgctgaaaggacccagatatagctgtctcttgtgagactaggcaggggcctagcaaacacagaagtggatgctcacagtcagctattggatggatcacagggctcccaatggaggagctagagaaagtatccaaggagctaaagagacctgcaaccctgtaggtgcaacaacattatgaactaaccagtacccgggagctcttgactctagctacatatgtatcaaaagatggcctagtcggccatcactggaaagagaggcccattggacacacaatctttatatgccccagtacaggggaacgccagggccaaaaaaatgagaatgggtgggtagggaagtcggggaggagggtatgggggacttttgggatagcattggaaatgtcattgaggaaaatacataataaataaaaaaataaaaaaagaaaaagaaaaaaattaaaaagattttatttgtttgtttatttatttatttatttatttatttatttatttatttatttaatgtaagtacactgtagctgtcttcagacacaccagaaaaggctgtaagatctcattacggatggttgtgagacaccatgtggttgttgggatttgaactcaggacctttggaatagcagtctgtggtcttaacccctgagccatctctccagcccaacaggaaatccttaacagaagaatcttgaatcgctgagaagcacctaaagaaatgtttcgtgttcttagtcatcagggaaatgcaaattcaaataaccctgagattctactttacactcatcagaatgggttagatcaaaatctcaagggacaacacatgctgggtaggtcatggagcaagaggaacactcctctattgctggtaggagtgcaaacttgtatggccactctggatatcaatttgatgatttctcagaaaattgagaataagtcctcgagaccaagctatactactcctggacatatactcaaaagatactccaccatcccacaaaggcacttgctcaactatgttcatagcagccttatttgtaatgtcagaagctggaaaaagcccagatgtccctcaagtgaagtattgataaagaaaacgtgtttcattcacacaatggaatactacccagctattaaaaacaagacatcatgcattttgcaggcaaatggatggactctcttacaagtggatattagccatgaagtacaggatgaccatgctataattaacagagccaaagatgccaaataacaaggaaggtccaagggaaaacagctgaatatttctcagaagggaaggaggaaactgtgggagaagagatgggaaggatggatcagttataggtagaacaggagagagagagagagagagagagagagagagagagagagagagagagagagagagagagagagagaatgaattattgataggtaggaccaatctctatgacatcccagagacctaggattggatggaagctctaggaggtatatggggatgactagctgagtctcctagcagtgggggatatgaatcttgaagtggccacttcctctagccagaaaggactctaagagggggggataagaaaagtaacacccccacaaaacctttgtttcaaaatatgtcctgcctacaagataacaaggacaaagacagagcagagaaggagagaatggccaaccaatgactgcacatgggaaagcaccaatccctgacactaccataatcctgttatgcttgcagagaggaacctagcataactgttctctgagaggctccacccagcagccaatggaaagagatgtagaaattcagaaccaaacattaggtggagctcaggcagtcttacagaagagttgagagacctgaagaagataggaactccacaggaagaccaacagaatcaactgccccagacccttggggctctcagagccggaatcaccaatcatagagtaagcatgagctggacctaagccctctgaacatatgtagcataatagcagtttggtcttcatgtgggtccccaacagctggagcatgggctgtcagtgaatttgttgcctgtctgccttggatcctgttcccataaatggacagccttgtctggccttagtgggagaggatgtgcctagtcctgcagcaacttggtgtacagggtggggagtgttagtgtggggagttgacaccaaaagagggcttcccttttgcaaaggagaagggggaaggaatgagtggaaggatctttgtgagaggtactgggactagagggggtgctaatattgggatgtaaagtgaatgaatacatgtaattaaaaataaaggaagaaaataatccctcaagatgtgtccagccatttgggttttagttaattccagatgtagttaagttgacaatcagaatagctatcaaactactcacaaaaaaaataaaaagataccttacactacattgcagatatatggtgtgctctgactggccttccttaagtgtgtagacttactgtgtaattttgctgtctgttttgtatgactgattctccttgaatgtataagcttattgtttctcctgccccgagtgcccactccccacctcagaatttatatctggcctttctagccactatatcgaatagggattccaacatcatttgggtatggttaaaaatctagaatatttgtaacaaaaagattaatgtaaaactcacaatatggggttgataattaaaagtctgtgcgtaggtaatcttaaaggaaccatatggtatttataagcaacatgtggcctgctgtcacccttaggcagtcacatgtctggcagccatctttgatagggttggaaaggataccctatgagcttcaccaccatcttgttaagggcaaccacatcttgtgggctgaccagagagacaagaggtcctcgagatattttgagttgtacatttctgtatgataattactctcctgttctgaaaaggtttataaaagatagaattttaaaacagtgcttgtttagtaaggtattaaagttgtatcttcatatgttcatatgcaagatcatactttgctggaagccaaactttgtagcataagagtcaggtggtactgattttagagacattgagttgtttgcactgttggagatttggtttgccttgtacagagtatggttgcaccctgtgtcttcactcttgaagtaaaaaatgcactttattttgatattactagagcacacagatgagagattttaaatttctttaaaaatatttttggagttttacagaaaatttaaatgaaaaaaccctggatacatcaaaggaatagatcttaaaaatatttgaatttataaatctatagggcatttaaagtttataaggaattttgttatgtttttattaatatgtgatcttgataaataaataaaaggctaaaaatttgggtcacagctctgagcacaaaatattaaacaccagagagtaaaagattcctatattatgatacagcaagataattatttaaataatctggcaaagggtttggagcagtggttctcaacctatggattgagatcctttggaggtcaaaagacccttttccagggttagtctaagtccacctgcatgttagctgacacagatggagagagggatcaatcacatcagctagactggttcagatcagccatattgcatagatctagacattcttttttctttttttttattacgtattttcttcaattacatttccaatgctatcccaaaagtcccacccccactcccccccccccccccacccattcccattttttgtccctggcattcccctgtactggggcatataacgtttgcctgaccaatgggcctctctttccagtgatggccgactaggtcatcttttgatacatatgcagctagagtcaagagctctggggtactggttagttcataatgttgttcctccgatagggttgtaggtctctttagctccttggatactttctctagctccaccattgggggccctgtgctccatccaatagttgactgtgagcatccacttctgtgtttgctaggccccggcctagtctcacaagggccagctatatcaccgtccttgcaacaaaggcttgctagtgtatgcaatggtgtcattgcttggaggctaattatgggatggatccctggatatggcagtctctagatggaccatccttttgtctcagctccaagctttgtctctgtaactccttccaagggtgattgtttccaattctaagaatgagcaaagtgtccacactttggtcttcattcttcttcagtttcatatgttttacatattgtaccttatatctcactatactaagtttctgggttaatatccacttatcagtgagtacatttcatttgagttctttgtgattgggttacctcactcaggatgatgccctccaggtccatccatttggctaggaatttcgtgaattcattctttttaatagctgagtagtactctattgtgtaaatgtaccacattttttgtatccattcctctgttgaggggcatctgggttctttccagcttctggctattataaataaggctgctatgaacatagtggagcatgtgtccttcttaccagttgggacatcttctggatatatgcccaggagaggtattgctggatcctctggtagtactatgtccaattttctgaggaactgccagactgatttccagagtggttgtacaagcttgcaatcccaccaacaatggaggagtgttcctctttctccacatcctcaccagcatctgctgtcacctgaatttttgatcttagccattctgactggtgtgagatggaatctcagggttgttttgatttgcatttctctgatgattaaggatgttgaacattttttcaggtgtttctcagcctttcggtattcctcgggtgagaattctttgttcagctctgaaccccattttttaatggggctatttgattttctggagtccaccctcttgagttctttatatatattggatattagtccctatctgatttaagatatgtaaagatcctttcccaatctgttggtggtctttttgtcttattgaccgtgtcttttgccttgcagaagctttgcagtttcacgagggcccatttgtcaattctcgatcttacagcacaaaccattgctggtctattcacgaatttttcccctggggccatatattcaaaggttttccccacattttccctataaggttcaagggctctgggtttatatggaggttcctggatccattaaaatgagaccttatccaagggataaggaaggagccatttcgaatttttacacgagaacaccagttggcccacaccaattggtgaaaagcttgtttt

SEQ ID NO: 49 - DNA, 247850 bp, Mus musculus; identical to SEQ ID NO: 46

SEQ ID NO: 50 - DNA, 80000 bp, Mus musculus
agacctccgattaatccaacacagttggggttaggggtagcaaaaagaagggcacgaatgttttagagggtctgtcttttcttttccttcacctcttgcctttcttttcttttcattttgttttctatttctctttctaaggcctctttgtatgtctctgactggcctggaacttactccctaactcctgctggcctctacctctcaatcattctcaccctgctctctgggagctgggattataaatggatggcactgtgcacaccttcagtggctgtggcttaacaagttgtcagaaaacaaaagaggattcttttaatatccaattctttaaactgtgttcctacctggggactgttgtgctttctttagctgtttagctttgggttttttgttttttattttttggagattgagtcttcctctataactcaggataatccagctgcttctgacgcctgagtgttgggattacagacatgagccactcggagctcttgttattcttcttaccatggatttctagaagaagctcaataatactatataataatataaaatgtatggttttggccctcctgccatagggaggtaatggtaactgagataatgtagttccaggagtaaggggagctgggtatggtagcatcacttaggaatggtagtttggactggagacactctaggaaatagaatggcagaagttccggttgatgctatggcctgtgccgttaatatattacgtagcccagccaccttgtctctgtgcttagtgtgtgttgtatgtcttctgttaggtaccagatttgcttttgctttttctagttcatatgtttgggtagcttttgtatggcttcctctttcccttaagttttgcttgcttatgctttcctattcgtttcagctctcaaagcctcatcttcgcattgcgtgttggctttccatgtatctttctcctttacctccctttaatgagtcctgtgaataacccatctccagtaactgagaattcattgctagacctgtcctgttccaggttacagtgaatagtctgtagatctttggtgttacgctttttgcttaatatgacgctgcctgtgcttttactctgtttatttctaatgtacagttaacaactgacttcttccatcctctgtttcaggggtttcatttgcaaatgcctgcaggatccagatgggggacatgtgtgagatggctcctggtattcattctctctctctttctctctctctctctctctctctctctctctctctctctctcaaagctgggttttgtggtgttttttctttatcagagagattaccggatgccaagggacagatggtggatctaagaggatgggagagtatttgaggccccgacccatttaatgtgcaaaatgcatctaaagagaaaggctagtgggctggtgagatggctcagtgggttagagcacccgactgctcttccgaaggtccagagttcaaatcccagcaaccacatggtggctcacaaccatccgtaacaagatctgactccctcttctggagtgtctgaagacagctacagtgtacttacatataataaataaataaatctttaaaaaaaaaaaaaaaaaaaaaaagagaaaggctagtacttggctgctgctaattgtctggagacgtgcatccaggattgccagggcttctgattcgctccaagggaaacttgagtagcttcaaggtttttgttgctttttatgcctcacagtagaagactgtgttcataaatgctttaatagtcttatagtctctgtctatttgcagttgtattactgtgatgttaactgtgttctgttaaccaagggtatgtggaacacttcctactgcactcagatgagcccttggaggtttcctttgggcagagtttagaactggaccacaatgtgcttacatctgtgtaaattaggataaaatctaggaaaaatagatttttatacatacagaaaaacagagaaacagtagcaaagaagaaaagctggtttatttgtttgccgttggggagctggttccagctcagctagcttgggtgataaccatttgccatcatgcctggcaaaatcttgggctttttggttttgttttttaatgttcttctgaaaaatcaaataataggtctaaatttccacagagaaattgtttcaattagtagagcatttggccactatgtttttccttggatcaatccagcacactgcgggatgcagggtaagcaagaaaagatacatcttacaggctgtttccactgggtccaagctgtagcacggctattttaaaaggacatttaaaatttaccacattgtatgctaagatgttttgctgtttatgttacttcccccgctacttggggcttttaacattttctttggcgtgcgtgcatgcgtgtgtgtgtgtgtgtgtgtgtgtgtgtgtgtgtgtgtgtgtgtgtttgtgtgtgtgtgtttccctgtgtggagtgttattgatgaccagttgtcttcctcagataattaacaacttatatatggaagcagattctctcagtgagacagcttgctctggggggtgcctgtttccagcttttaagcacagggattgcaagtgggctgtcatgtccacacttgctggcattcagcttgtgctgggcatcctaacctggcttcttaaatgttaccagtagatacatagctaactgagccctctcttgagcctcaagttgccagcatcctccatttattttgtagaaaggagagaaggatggggaggttaagaacgtgcacatggagccggtcgtggtggtgcacgcctttaatcccagcacccgggaggtggaggcaggcagatctctgagtttgaggccagcctggtctcagagtgagttcctggacagccagggctgcatggagaaaccctgtctcgaaaaaaacagaaagagagagagagagagagagagagagagagagagagagagagagagagagagagagagaaagaaagaaagaaagaaagaaagaaagaaagaaagaacacgcacatgggagaatgcttgttctgtgtgcatgtgtgtagggcagcagcaggctcctggatatcagaggacagcatctagagtctgttctgtctaccacctatgtccttgtggttgaactccagatatccgcattatggctggtgcatttaccttctgagccatgatactgcgacccaagtttgttgttttcagggtgtttttttgtcccctcttgtggtgctaggaatagaacccaggaccatgtactaagtgagggctatgcaaaaccattctactattgaccgagctacatgcattgagcaccactgggaattctaggtaattctatctttgagccgtagccattaagtttcctttggtggcttttatgttactgcctcagccattggcgtagctggaattatgggcctacactatcagtccacttcccagtcttttttattgaaaacaagctaggctcaagttgtgtacctcaggctggcgtagaccacaatcatgctgcttcatcatccagaaaaagaggattacaggtttgccaaggctggatcaattaagtaattttattttttaattttttaaatgaactctcttaaaagatttatttattttatgtttgtatgctgtagctgtcttcagacacaccagaagagggcattggatcccattacagatggttgtgagccaccatgtggttgctagaaattgaactcaggacctctggaagagcagtcaatgctcttaacctctgagccatttctccagcccaattcagtaatttaaaatgcatgctattttacaagagtttaactagaagttgactatcagttgtctcacagatagtaaaggatagggaagtttgagaagttcatcaattctttaccctccctcaaaaagggaggccataactaagtccattgtatgcagtcagtgatttggggctcagtgtcttcagaagatttctaagttgccatggtgttgaagtctcctaatagtgagcctaaactgttttaactgcattttgccttgagcttttcactttacttagtgtctagttgttctttagaatgcacccaagtcctgatttgtctttgtaattaactctgatagggtatttctctggctgcatccctctgaatagttgatcctcacaccccccccccccaaccgccatgtggcaggtaaagatgtcccagtggctggcagcagggagacatctatccacttagagaatgctgtgccagtaaagctggcgtcttgaatttcagggtgagcctggagaagcaaagttactaagcttgttaagtatgaagtatttaaactcggagacgtagggaaagcacggggacaatacacaatttcaaggcttcctgagagctgagattaaatgtatgtataatgtctacctagatggttccttggctttttgtttgtatgatttattgattaattttggtttttcaagacagggtttctctgtgtcctggaactcactcccaaaaaagggaaggatagaagaaagattataaaatgtacatatattgatggaaattttgtcatagctgtgagattccttccagtggtctagcaaaggtacctcagaataagattcataatgaaattgaaattctttgggcttgtggatagtttcatagtcttaaggaaaggatgtctgtagatacctccattcctaccaggcctttggataatatggggtcctgctgatcttaatcttagtcctggttctgctgggtggctctgaaagccttatcagtccttggattgcttaacagtcaggtgactggagggactgctgactcatcgacttgctgtcttcaagtgaccttcaggattgtaggataaaagacctgaggcagacttttaggcacctctctggggtctggcacagtgcattgtaaaaggtgacaatgaaattccttaggtttatctttgtgctttcagccctgatgataagatagcttaggcatctgcagtttttagattgataaaccttgaataattaacttcaggcatctgatccaaaagaagtaaccaaaactaaaggcagatgttctaggctttcgtccttggtttagtgaccttgtaggcccaggtaaggagagaagtgaccttgtagacccaggtagggagaggagccatggctttttagcaaaagaaattctaagtgattgttattaaaacaacaggagaaacaacgtatggtcttccattagactacatatattagaagttattttgcattggtaaacatttagctaagcagacatacacactcataaataaaaataaaattttttgccaggcagtggtggcacatgcctttaatcccagcgcttgggaggcagaggcaggcggatttctgagttcgaggccagcctggcctacagagtgagttccagggcagccaggactatacagagaaaccctgtctcaaaaaaaaaacaaaaaacaaaacaaaaaaaaagagtctcagagagatctcagtgggattctatttgttgataaaaaacaaaacaaaacaaaaccaattaaataactaaaatgaaaaatttttgtaagaaaaggtatgtgactatcttagtatatctgagttcaactatctgacttaatgcatgtgtttgtttatgtattttattagtatagtctgttgtttgtgtttttttagacaggtcctaatcttaatgtacacctttttaccttgaattaaaacatagccaaggatggtctcgactcttagctttgtgcagtttttacaaatttctgatacactgctgttctaagaagtacttttattgtttaatcttaggtgtctcctatgtattcctaattgacctgaaactaactaacctggcctgaaactcacagcaaatctcctgttcccacctcctgcgtcctcagtcgacatgtgtgcaccaccatgtccttcactaacattgttttagtttatagtgcagtcatttcttatccactctcttacctgggatattgtccacagaacaacacttgccataataaacagggtcatcattttctaaatattagcatatattagtttttttttaagtatggtgtatttgtgacactcaggttttttagtatagttcatttgtgacatttttgtaggcttaaatctttcttacatcgttgtaattatgcaatattttccttttgtgtccagcatactttacttaacatagtatccttcatgttcatgcatcatgtatatttgagaagtatttcattgtatggacatgaattttgcttggccattcatgttgttcctataactctttatatggctacattttgttcttgtgctatgtgtacatagagctactctgaagcatgcttgttgcttttagctataggaaggaattctatcaggacaggattctttacatcttacaataaaatccttcaaattcacttaaatatgaagatacgggattgggctacgtatgcagttggtcctccacttcacaaatatgcttttcctttttctgtaaatatgcttttattttatgcacaaatatgcttttcctcttctgtaaaattccagctgagcctctgtatttgctttttgaaaaaatttgctattgaggattatataaaatcatttcaatttagcacgcagaaattataaagttataaagtatatatgctgatttctgtaaatttgacagaagttttagaacattagggtgggggaaagggtctcattatgtagttctggtgccctagaactcactgtgtagtcaagctggcctccaactcatagagatacgcctgcttctgcctctgaagtgctcagactaaaggtgtatgccagtatgtcagcccaactttaagatagttattaaaggcatataaagaagtctaattttatccctaaatttagttatttaaacatgttcaggtacctgtacagatgagaagcggtgaactactatgtggaaatgagtccaggtcatttacttagtcatagtaaagctggaaataataggaaggtctttggaatggttagagatattagtaaaagaaaaatggaaaagtctattacgtgctgttaagattttgtgcagtacctgtctagtaaaaacctgaatatgcctcataaagtcgggcagactcaacaaaacctcatgaggacttggggcaacaaccctagggagtacagactcttagaaagataattgtactatctggttaaaggactaattattactcctatcactttagtgtggctcaaggtaagcccaccttcctgagtgattgtcccttggccaagcacatgactcagcccaactggattaatttgtaagggaggagacaatggcatgcctgcacccagaggtaaattccattctttctgctggtagataacagacttccgtaatgtgccttgaatactaccgctgaaacatttctgctactatttccattatacgttatagacaagtcatccaacgagtgaagttcaaactttgctcaaagagtaccttctctgaatctaatcatacagcagcctgccatgctagtgctttgctatattttctagtattgtctttgtaacttcattgatagtcttgatatttttttggtatttttatcccccatgatcagtctttcctgataacttacagtctaccacacttaaaaatggtactccttcgaggccaccctggtctacaaagtgagttccaggacagccagggctatacagagaaaccctgtctcaaaaaacaaaaacaaaacaaaacaaacaaacaaaaaaatggtactcttttcaaagcagtatattgattccgaaatagagagctctcctttggaaggagccaagcatttccagagaacagtttgttttcttatacattggaacaattagaattgtttgtgtgtaggggacatgtacattggggtcagaggataagttgatagttctctccaccaaactgggtcaaacttggcaggatgcatctttatcccatgagcaatcttaccagcccagtattgtaaaataatataaccatcccttagtttctgactccagggcccctacccctagtgttacagctttcatgaacaagaaagccttgctccttgctttttggctagatcacctcccaactttttcttttccgggattgcctttggtccattacagaactaagaagacaaaaaaggttcttgtggggcaagtgctgtcagtcaggccctgcattgcctggtctctttagtgctctctagctctaggttttcaacctccctttaactattttgggttctgtctttccctatggtggtgggtctcagcctgtgagtcttgaccccttagcaattgtctacgaccattgcagacacaaatgtctacaataaatgtataaccatagcaaaattacacgcatgaagtaccaatgagaatagttttatggttgggggtcaccacaacatgaagaaccgtcttaaagggtcttagcattgggaaggctgagaaccactgctctatggaaacttatggaagttactctgccccaaaagtcacttggattaaccctggccccttagccattccaaatatgagacttgtgatcatttttactctgccatttgatctttttaatgtgctctcacaggacaacttgagcagaatctaagagattcctttaattacaaggtgcaaatgtctgcttggcattagatttgctgtctctttggaaggtgtgccgcatctttagaaaatctgtatcctttatgcctgctgctacccccagaatcttaagacaagggtaagttgtttgagataaggagtgcagatccttacattaaaggttcactgagtaggccctgctgagttttatgtgtaagcattagaacgttttaatcagtctcctttccttctgtaggctggtgggctgactcaaactaaaggaaactgcatgaccccctccagcattttaatagcttggcttgtcatctattaaggagcaaatggaaatcgtaggagtgtaataggaaatgttatggatacgggtgatacaagtatatgtgttgctttaggacaagaaggaaagaacatctttccttttagatcagcctgactggttgattttttttttaacattgcatagtgctttcaagagctaacattccaggaagcatgtattgtaagtaggtaaaaacaccagttctgctccagtttgttgacaaggcataatcctttatctgccccccagctcactctaattctgatttctcctattttggaatttattgtatgtccagtgtatttcaaggcggaatttaagggctgtaagagaacccactcatttaggacccctgaacaatgttgcaaaatatggttttctgtggcctaatgctatgcgatcaaggggctatcaaccaacaatggggtagcgtgggagaaagaaatgatttttttaagccaggttgtctgtgtgtagctttggctctcctcaaattcacaagcttctgccttgctgtgcctcctaagtctgcctcgtgagtgttgaggtgtgtgccaccacacctaacttcaaacattctcttaacatgaataggaaaaaggttttgtaacacaagttgcccagcttatcaggtgtgtttgaaaatgtgataggtcagctctccagccactggagtaattgataacaatgactgtcgctaagcagaaatgggcagtttttctgtttctttagcttggagcctgttcagcacgctcatggaccctcatctttctatcatccccttctcttttggagattcaactctcagggcacactttttatcccttagtcctacactattctagaactcatttagcacaggcccacttgtgaagtgttgagattaaacttgtcagccatcactcacagtctagcaacatgactaagcacgtattttctttctctttatatttaaggatataattttcaaaagttaatgtaagaaaggtttccttaatatcacatctatattcccctggtcagggaagccggttttcttcagagaaaatttgattgctagaaaaactagtaccttatttgttccttgggagtaaaatactatgtaatgaaactcattagtaacttgggtgtcctggtgatactacaattttcttgctaagaaactacagaaggtgcctctggtttgctgtcgttcccattagagtaagacccagaggtgtccacgtagatgctattatctgtgtttctttttgagactgcctgtcttcagccttttaaattggtgttttagtatgcattctgcgtttgacctttgactggatatgtgaacatgatagtgtgataattccgagtttgtggccagcaaggagctcctgtgcattaacctctagaatgttgaaagagtaatgaagagaagaaagaaagacctctcttgtcatcaggaggggggatgagcctgaatgcagtagtgctctttgtctaccaagaaaagtaaatgtttttatggctgttacatataatgactgcacacaatattcagtttggaccttgcaggtgaggtacttagatatgcctattttttattgtcttgaatgctttcattgcacttacacaaatcccagtgtcactacatatagaagagtgattcgtgtggatttgagattgagaagtagcactgttaaactgattgcttcaagttgtcctttggctcacatccttattgtggcgtgtgtgcatctgcgcacacacacacactcacatcccacaccctcagattaattaaggataatgctactttcccattccctctgcattcaagtcactgaggcaggtgggtgactgccttcttaatttttgaattcaaattctagcacatgaaatattgcctcagtaatgtgtaagtgccctccctgttttttgatacagaatatttttccattacaagtaatgagtgatcagagttgcccaatactgtgtaaaatgtaaggaaggtcaagtaggcaacaaatgcaaaaatcttatcattttatcacaaaatgcaaaacagtccttaaaactttgggaatcagagtagcactaccaatcttgtaagggttggttatctatggaaagtcagattaaattctctttgatatgcaatgtccttgaccttttggaaatactgttcctccactgataaatctcaaggtcctcttttcatttacaaatgatcaaggacaggttagtaatagcactaaaaccaacatcctttgctttagtcatcaggtaatatatttccggtaataagctatgtccttttaaaatttaatttaattattttggtttttggttttggtttatttttagtatgtatgtatgtatgtatgtatgtatgtatgtatgtatgtatgtatgtattttggtttttcgcgacaggatttctttgtgtagccctggctgtcctggaactcactctgtagaccaggctggccttgaactcagaaatccacctgcctctgcctcctgagtacggcaattaaaggcatgccccaccactgcccggcgctatgtcctattttgctcattagtttattgtgtaaggttatctaatgatattgaatcgcactatcaagctttgaacatatggttaaatagaatttcattgtactaaaaaaaaaaaaaaaagaatttcattgtactgctgagctttcttagtactttctcaataatagcattggaataatttgactgctttaatgggtgttattagcaaaccctttgatggtaattgtggaactgcttttcttgttcatggtaagtatatatgctctgtgtcactgaacagtatgtcttaatggaaagctgaagtaggataacttagaatcataccactgtttcttgtttcacgtgactttgacctgatatttgctgaaacaaatgaagtctttgaaatttaggtttcctacaaaaaacaaaggatagcagtatactgttcatgtgctctgttttctcagtgggcatgtgtgttgctagcctttgaatccaaaatatttttttcatgacttggtaaacagtgttagttttgcttgtattcacttgcaatctcttaaggatatgcaagagttaagtttctaggaataataaactatgaggattagacagtcgcacacagctccagtgagctttatttaatgacagatttgtgccatagagagttctggaaacactgagcaggttataagatgcagattcccagggaacaaacttcaagagagtgtggattacatgcttaagtctgatttgtatttgcttgttttcattcttcagttgtttgttcacttggggtgtttgtttttagtgctttgggtttttttcttctcaggataatgaggtgaattttattagaagccaatgggtaaggtagttcatttctttagctaagctgacatggcagtcagggtctgttttgtaaccaccaggcatcttggtaaggggaatctacctttattactccaaatatctggcttcctagaactttgagcttagctttagggagtgtggtgtttgattcaatatctttatatataaagggtatgggcatcattttttgactctacttcctgcttgggaggggagcatcatgcctttggggtctagagtgtgataaggaaggacacctgactgcttatctcagaaatatctctactcagaaatatgcaacagaagctgtggcgcctgcctttaatcccatcactccataggcagaggctggtggatataggagttcaaggacagcttgatctacagagctaattctaggacagccagggctaaatatggaaatgctgtctcataaacaaaaccaaaaagcaaaaaatcacctgtatatacgaggcacattggtttccagttattccattaaacagttgtacttgaatggaccgtgagaagacaattgatttagtctgtggtactggttttatgagtttcactaatgctgtttatctttcattgtgagtttctattgctctgtagtgtcctgaatcattttatcctacttctgtatgatgtgtcatgagaatcaactcattgtcttattgaaaacccatcaaaaataatttgtgtctcattgcatttttgtaggattatattttcaatatcttagactgtgtcaccttactgtcatgagtagatttgatgtctgggtaactttttgctatacgctgttcattcatggattgatttttgttttttaagcttcctcatttactctccttttgtgacttccattatgtaccctaactatagaattcttctaagacactttaattttttgtacaatgcttaagacttattacgagtgttatttgctatatatgttggattataacttatattttaccaataattgtctttttgtgataattgatactgaagattttccatttgagcgtctttgagatgagaatacatagttccgtgcagccctttcttctacctagagtgttttgtggttaaatgtgcttaggctttaacccaggaccttgcacatgctgggcaagtcctgctcttgtacaccttaatcttttttttgtttgtttggtttttgtttttttttgttttgttttgttttgttttgttttgttttgtttttcgagacagtgtttctctgtatagccctggctgtcctggaactcactctgtagaccaggctggccttgaactcagaaatccacctgcctctgcctcccgagtgctgggattaaaggcgtgcaccaccacccccggcctgtacaccttaatcttgaaaatcaactttaatccttaaccgctttgatggtccccattttctagtaaaactttgtttctccacttgatatgttcccatttaatgatcaccacaacagccttctgatgcattccagtgaggttttaaaggcaattatctaacacctaagcacaatcataaaaattctgtgcaccaggaagactatagtctacccttgcatatctaatatatatgtagaaaacaagcgcaggaactctgggtatgtgggatagagcattttggaggatgttcctgttgcctgctcatggtagagcatgtccccaacatgtgtgttacaaagggcttaatctctagcacaaaaaaaacaggcaatattattcacttctacattttgtttttggaatagctgacaatgaaaattacaaacagtattttataaacataatctgtaaatgggaaaatcacatcaaggatacattccctttgtctaccttgaaatgatccaaggccagccttgtctacaaagccagttcctgaacagccagggctacatcgagcaaccctgtctcaacagggtaaacaaggaatgaaagaaagattgatagtctcttactatgttaggtaatgtagcttttatgcaaactttaatcagtggttctgaaggcttaagttttcagtaacatattgttggagaaatttgtatccagacatccttattggccttgaattcgtttaaaggtattttctgctccttgtctaagggactgccagaaaatgggttatactgcaaggttgtgtttagttgagtatggatgagaattgggctcaagacactggagctgctgttcatcttcctacttggctcagagacatgacgatttataccagattgtctgtccattttaaacttctaactatgaatatagatacaccttaagggtcttcaatttcaaggtgcttattaccctataatcttaaaccccaggctaagattatttattgataatgctgccaacaaatgtcttttaactcatgagtaacttttgtcggggctacaaggggttttttaagagtctgtttccctctcagatcactttttcatgttgatctaaatgtttgtccacagttcaaatcatttattattattattattcagttctctcagtagtcaggatattgaattagtcccaaagatgagagatattcaggtatatagattaaaccttacaggctgactagttactcgctaagaggtttggggtaggatatatggaggagagttttacagggaaggaattttttgtcatggatagctgccatcctctcattccttagatatacatttagtttcttctccatagaagagccgtatctaggaactgccaatcctcagtaagacacggagatagcagcggtgccccatcattctcatctgaatagtctcttgtcactggcaggctttctcctgaactttatttttcttttgaagtgtttagagacttgaaatgttcattgctttactttgaagcatcagatatgtgtaatatccactctagggtttctgatctcaaagcattataaagcgaggcatgttggcacatgcctagaatcccagcatttcgggtccttatacaggaagaccatcttgactttgagtccagtctgggtttcataacaagtccctgactgaaacaaacaacaaaatctatgaacatgttttctactcagacctatcgtattgatctttactattcaaataatgcatttataatgaggacaattttacttaagtaaatggttcagatttgggaaaggaagctctgaagtgtgcatgcaaacagtgactctagggtttgggcataggcattagctggcctgtttgttaattgcgtccactcaatgctatcttagttattgttgctgttaatgatggagcgggcaatgcaagaattaaaagaagaaagttaattattattataccttttgaatggtcaatggtgttgtggggagggatcatggacgtttttaatgattcactaatgtgaagttagcccatgtaggaaactcgatgattcttccattcatgctcttgattagtaatctattgcctttcttctttgttctaagttaaaagcttttgaaaacttgtgttatagctgaataaaggtttttgtataaacacagaaaaggatgtttggggaatggtcacagttgacctgaagccgaattctaactgataactagctatgttagttcttgtgactgtcatccctggagagcaagaaacaacagctggccttggtgatcaggagaacttcatggatcgcgcagcaacctggagtggtgttcctctgaagaaatcctactcgggtggatataatacaacctgctaagtgttctagcacttagcaggttgtattatcattgtccgaggttatggctctcgtctatcaaactaatccgtaagggcaaggatggtgactttgtactcacagtgcctaatccggtgcacattgtaggcctcattaaatgtttgttgaatgaaaaaatgaatcatcaacagacattaattgggcgcctgctctgtgatctccatgggctcagcttgttcctgccagtggccttcaacgttcaagctctccgcagcgtccttatttctgcagctcattcctgtgttctgtgtagtataatcatagtggatatattttacctttcaaaccaattccaattgattgataattgtgcctcgactgtgttttataaaaaggattccatatctggttcttttctatcctgagggtgtggaaggaagggataatagctcatgtaccataaatgtgatattttctatgaaatactgtatttatgcctgtgttttggaaatgcctgcttgtcattgttgcatctctgttgttgttactataatcgctaccgattactccctaggttggactacagtgatcactgagtaggagcttcgtctttaaaatctggggtgtgctgttatggttggtattcattttcctttacccgctttccccatacctccatttataattttattgctgctcatagctccagaaggatatagtaacagagcaggcatggcctcagtgtggtaagctaagtgagaacaggaagtggaaccagggtagaaaaccccagtcttgcccctagtgacacacctcaagcaaggttctccttctgaaaggtcccattacattcccaaatgtagccaccacctgggatatgagtgttcaaatacatgaggtagggccacggtgttccttcaaagcaccacagagggcagaatgtacaccctgctagaatagctttctatgaaaggatccatctcttcactggagcaggcagacatatgaagaagacaacttggagtggtcgtgaaaggatttgaggtttggcatggactctaagaagcacgagatttgtggttttccttctttgtttcttgctaggtagtcctggctgtctagtaactacctacaaagatcaaggagaccccaatcttgtagcaatcctgctgctgcctcacaattgttaggattatagacatgggcacatgttcattagaaagttgcactgttctctaattcatcttttaagataaactatagagggatgaagattagcatgttacaccaccacagatagaaaccattctagtatcacgaaacatccaactcatgtagaatttccattcgctgtttgggatgatagagagatggaattgagtttttagaaggtaaaccacacaagagagtctagggaactgacagagcctggctggactgcacagttcgtcctcaaacgactttttactgacccagctcctgaggaaaggaccctggtgtctgaacttcaacgctgatttaataatcattgttttcatgactggtcctttagaaatctggcctgctttatatttgcccctggggcttagacaagggagaaaaatggaaaatactgtccgaggtaaccacagccacacagaacctcatacaccaagtggttagccttatcatagagcacaggtgcctgttctcagtcacatgctagccctgtcttaggattttgtttacattaaccattctatttcacagtattaatgtccttatacacaagatacacagaaatctttgttgtgttagacatcaacaatgaaaaatccctcaggcccaaatatcagaagatagcacgaaaataccaagtcagaacgaagagggtggccagtggatttgaaggtagatgcagactttatcatggttactcctacaatacagaacattcttgtttattagtctgataccagccatctgatgtcatgttggcaactagagaagctttatataagaacaggagctctgtaagaaaatattgtaggaattaggctttataagacaatcgtggcccttggcagtcttggttaagtctcttaggatggttagggtagaacttaggtgtgaaaagtcttgactttcaattattctacattgaattcccagaacacctgagtcaagctttattgtgtttattacccttggtcttgcctcctcattcttgtgtggactccttaactcctgcctctctttacccaacccaaatgtgtttcagcaatcttctttccctgcccagtactggatctgtgaaaagctgaatcatgaatcagtgagtgtgcggattggaacccaagttgctctctggatagaacgaaaggagtcgtgccccaagaagatggagagggaagttatgaaatgctgtgaccaaataacaaatgctgatgtttggggagataactgtttcccataggaaatagagtgaatgcgatgtctttcttttgtgagggattcatagaccgcttctcaacgcttgttacatgttactccttttttcgagatttttatttacctaactgggaaagaaaccagaacaaggttttcattgaattctgatacaggtatttaaagacttacggacaagatatagaagaagaagtggtaattaactgattaaagaagtacagtttatatccagtagacagacaggctccagacatccttagtgctgtcttagcatcaaaggttaatctacctaatacttgtcatcctgaaatgcatggtggaacatccaacagacaagagctacttcagggaaggactatgatttttgtcgtggaagacatttaacacagggcagctcctgtgcacttacatgatagatattgctcttccggggactctgaatgctcatcccactttcagctcactaggcacatcgaactagaaattttatcatctcgtgaattagtccaatacctgaaggagcaagagaaccaacacccagttgacaagaatatgacctgttgattgaagaccattaagaaagtaacttgattcagttggactggacttttttattctattgaaaaaggaatttatttcccctcagtgaacgtaacatgatcaacattttgaaagttgtgaacatgcatagttctataatttacaaaataattataaaaatctgagtatggatgcagcataatttcagaacagaatagccatcatactttttatatatcttaaattcgagttttcaagagtatatttctatgttatatcctttgattagtacaatataaaatctacatctaatatgtacttcaggttttattagatcatgccatattactgtacaatttggacttttccatttttatataaaatgtaacatgcattgtacattaatatttatatatcttgtttatttatatatctttagaattaatttctgccaattattttctttatttgaatacttggggtatcataaaggtgctgttgaggtattctcaatatgcttgtacaacttcctgcctgtagttaataaatgtggatatttcattaaacaattgaaatataacattttgatggtatctgattgtagttctatagattgtaaaatatatgtagttgcatatcttcagtccatgcagactgtttttgtggctgggggttgtttcctggagagggtgtgttgccttgccttttcttgagttgtgtatgtgccatcatgccgagcagttggaagtcttctaaattcagtcactttttacccctttgcgtgggaacgactaatttgattgatatacatagctaatattttgacttctagaaagtgaaatccgtagaatcatatgtaatgtttagagtttggagtctggctgctctcacttcctaaatgtaattgagatttacccatgcagatgggcattagaccattctgtagttatttaacgtggaatatttctgcttctgacagttacaagcaaagttcataggtaattttaggtataattgtccttagctctgtgtatgagtcaatatgattatagtagccagacactagaggtatccgatttcgcctggacctggtgttacaggcatttgtcagctgcccaacatgggtgagtttccttttcttttggtgtttaattcttcccaccttccaaatattaattctgtcagaagatctgccattctttcctttgctgcgcactgtactttcatgtgatcccatttatcagactttgctattatttcttaagctgttgtagtcttttgaagaattattgcctatgctattaattcaaagtattctccattttcctatatgagtttgtggctttattttaaggtgttttatccatttttttatccatgggaacttttgttgaaagcagggagacatgtccagtgtttacaactgagctctctgccattggctcccactttggtaagggagctgaatgatggctatggctttcaaatatatgagatagatgcccgtggtacctaatatggcaattcaccgaattcaaggtacaaaggaaggccatctgaaagtgataggaccagtgagcgttcctactaagtctcagaattattaccctcccccaccaccacccccgcaaacaaacaaaaatccctgtggtaaaggccccaaggcatgggattgtttcccagtgagaatgcataagcacaatagtttgtcagtattgacccaggagtagaggctgaattcaccattgcacatgcctatgtcagctattttaataaacttattcaggtaagtggctggagcgatggctcaggagcctttggttggattcccagcaccctattttgccttctgcatggaatatgcgcatacatggtatagagacacagagacatgcaggtagaacatctatgtgcataaaacactaccaatcatgctaatagtttttaaaaggaggttttctgcgacatccatgttaggtgtctatgcagtgtagtctgaagtgtgatgttggtgttattcgttggtctgaggattgctttggctctttgcatacgaattgcaatattttacgctagttatctgatgaatatcattcaaatttgcacttaatttgtagatcacatcaattaatatgacttattctatgtttagtgttgggcagtgtctagtgtattaatctgcttcacagttttcatttctgagatcttggttacatttatttatacttgtttaatatttataaatctcttatgcatggaattttttttagtatagaatagagtttatttacaacatgggaagggagttgaggctgtagagacaaagaaaggcagagtgagagacagtttatttacaacatgggaagggagttgaggctgtagagacaaagaaaggcagagtgagagacgggggacggggggtggggaagaagtagaggccgtccatgagcactaggagagagagcaagagggcaagcatgaatgtttaatattacttacagagaagctgcaggtggcaatggtttgtgcctcatttctgtagctaagaattcaaaactatattgactaaataatatgagggcggggcagccctatgtcattcctcattgctgagaaaagtttcaggtagacaccattcatcattgtgttgtctctgcattgagtatagcacttatactcagataatattcttcttaaagcattgtcagcatctattaagatgatcatgtgatttctgaccttgattctgtgtatgtaaaatatttcatttttttgtattatgaaaccatcttttaaatgaaaccagtttactatgctctgttgtcttttcattgtgttcttgaatttagtttgcaagtattttattgaggatttatgttaatcaaggacaaaatattttgcatattcacagaatgtgcttggatgaagtcctttctgttatatggtagaattcagcagtgagtattatgtggtcctgagcttttcttcatttggaagacataccctggatgagtggttgtctagcattcaatgatgtgtcatcattgtacaaacctgtatccccagcactctgagaagaacactagaaagaatagcagttcagagtcgttctcaagttcatagccagttgaagccttgaatatatgtcacctgttcttaaaaactttgggtgtgtgagtgtgtttgtctgtgtctctgtggtgtgggtgtgggtgtgtaccccgagaattgcaaatttcagtcataggtgaaaaaacaattttggtggtcaaagggaaataatgtatttatgttctacatttattatttcccattaactagtagatttggacataatttgttcctttgtccaattccatgaggtatacagtttgctttagcattcttttttgatgttgtagtttattgctataagcttcccttttagaatccccttccctttgtttcaaagcctgaaatgtgttgtgtttacattttgatttgtctccagatagtttttgcttcccttttgattgcttctgtgacccactgattgttcaggggtatgttgtgtcatttccttgtatttgtaaaatttccaaacaccttcctgttatgatttcttatttcatcactttaaggtcagaggtattactttaaattatttcaatctttctaaatttgtcgtggctgtgggtggccttgaattcgagctgcagcaatttttgtatgtgcttgataaggtgtatgttgttttagtgatggaatgttctggatgctttcagttcatttgcacttgcattttttctttcggtatttccttgctaatttcctgcctctgccctatgcactgttgaaagtgacatctacttgctttgtgtgcttacatcttcttgggagcacaggcatttactacatcctgattggcttcttcttagaagatatgacttagcatatctccttgcttgtatttaccatttatatcaagtatcttttttgattcccacatcttcagcatatatataccctcaaatagttatatttaatataattgtcaataaaactttacttttatttttttctaagattcacttgtttctcgttgtttctctctgttttagttgttgttgttgttattggtttttaaccctgggctaccctgaaattcactatgtagctcacttgaacgtaaacttctaacacatgtcctgtcttagggtcccaagaactccctgcccccagaatctctccaccctggtgtacatgcttaaaaatgcagatattaatgctggacataagggtctaggtgtggattctctagtcattgaacacagcctgtgaacaaagctcctaagatgctcagacaaccttacagagttcattgcagattcaccaatgcatgagattgccctgccacaatgagaaaatcctcactgaaaagcagaaattcataggaataaattcagcacaaaataaatgcagataaaagttatttttttaatgagagagaaagcccagatggctgagaacttaaatgttcaacatgcttagtcaccacagaaatgcaaatcagaatggctaagatcaaaaactcgagtgacagtacatgctgttgaggatgtggagaaaggggaacactgctccgttgctggtgagattgtaaatttgtgcagccactctggaaaatctgtctggtggttcctcagaaaagtgaaaatagttccacctgaagtcccagctactgggcatatatccaaaagatgccccagaatacactaaggaaacatgttccactatagtcatagcaacgtcatttggtagcttcgggttctatgttctgacagtccaaatatattgtggactcccaggctgcattttcgtaatctcaataggagcattctctgtagaggtccacattttctccacacgctggaagtgtccctaaggagaaggctctgtcatttctccatgggtctgaggctgtggtcattgatctgctgttttggtggcaaccttcagtgccagcagtgcacatgaacttggaacttcacttaaggccttccctggtctccacagagctacattcatattccaggttttttgttgttgttaggttttgttttcttgttcttctttcttctctgacggtataatttcaactgaacttcaagtcaaatgaccaagcgtactgttgaaggtttcctgttgagttaacattgtcataattcatttgctgttctgatttttgaacttttcatttgatttatgacaaggcacgctctagatgccctagctaattttccctctgttaacttactgtagggaaaatgtttgttttaggttccattaattaattgcttctgtgaaccccccttgctgcatagcaaggggctatgatgtggacgttgccttcggaaaccctgtgctgtgaacattcactcaaaatccaaattcctacgtgtgctgccagccaacttgatataaagacattctattggctatgaactgtgtctgactgatcatctgggtgggggctccccatcatagagtcaagtattgttttcttgatttcattattttctctgtcttcctgcagctggctgagctttttaaagatggctattctgaattcttcacaggtaatgcacaaacctgcatattctaagggttctgggagtttattttgtgactgatagtttcatgtttttcctgactttgttcttgtagccctgcatgggcaactgtccatttggagaaggagcctcctcttgcaatctttacagatattttttggcgcaggaaaaaagaattaaaagccttaaaaaacgatttctaggaataggagctgtaatggacccacaagatggctcccaaccatctgtaactccacagtcaagtaacttgatgcagcttttgacttttacattcacctatacaaatgtggtgcacatgcatattacactaacatatgcaaacacagaaaacagaaaattttaaagattttctgaaatgtgtcaagctttgcctgtgtgttgtgtgtgtgtgtgtgtgtgtgtccatgtccttcacgcctttccactgtgggaaaatgtaatcttgtcatttgccaatcgcacattccctttctaggtgttttgtgccaggtcgctgcactgcgatgaaaagatgatgacgcaagtttctctcattctcttcctccagatggcacagtgtcagaatcgtgtgtggcctcctgctgcctgaaccatgccgctaagacagttgcccactgtgcagcttcacaccatctgcagagagcaacactgcagagcctttgggagagccttgccagtcgctgaaagcctggctgactgccaagccttgcactgtagactgaaaattgctctctttgctgagctcagtactaacacttagatcttcatggtctcctgggagaccatgtcagctgctgttcagtgagataaatttggatcagctgaagatatgcactctctatgccttccttgactgtcagctaaacagtgtgcactcctggcttagtacagccttggctgctgagagccccattcctcccctgtgctcttcattgtcctcatgatctggctttcatcatccattatactcctaacactgggagtgaagtgtcattgaagaatgttcatcaggcactacctcaaagggctggagatgattggtgaatgctttgattcttcattcctcctaggacacatatcaagcccccagaatttctctctatccagttgcaccagtgtgaggaacttgacggtgtcaggaaagtgaaactgcttctctgctccatataaatgtctgtgcagatgcaaagccatgcattacatggtagctcacctttaatcctagcactcaggagacagaggcaggaggatctctccgagctcaaggccagcctggtcttcacagtgagttccaggacagccaaggctacacaggaatcctgtgtacaggtccttggtattgcactcctctctataaacacaacttgcttttagaatgtgtggttgttaagttgttctgtgaaggatggataaaggctagctcactactacacccgtcagcttgctcctgtcacttcttctcacctttgagcacttagcatccctctccgtgttgtctttgctgaaatgcttgctaaggcgaagctcctctgtagctgtcctctagccccagccaagattctttcaagatttttctttggccttctgtaatttgaatatgatgaatgtttttatttactacttcattttgtattttgaatcttttttaaaccatgccaggttctctaggctcctggttctgatatgaattgagcgattatcttaggcccttgtgtttcaaatctttctttctttctttctttctttcttccttccttccttcttttcttttcttttcttttcttttttttttttgagacagggtttctctgtatagctctggctgtcctgtaactcacccggtagatcaggctgtccttgaactcagaaatccgcctgcctctgcctcccaagtgctggaattaaagtcatgtgccaccactgcccggcttactcaaatatttccttttttttttcagtcctctctagtgatctcattatacatgtgtatattctctagttgtcccagttatatgatgttcttctctctctctctctcttccccccaccctgtgtgtgtgtgcgcgtgcatgcgcgcgtgcatgtacccaaggaaactagaaaaggacttcaactccttgacgaaggaggtacaagcatttgtcagccacctgatacaggtagcagaatctaaactctgatccacattattaagcagcaagtgctgttacctgctaaactatctcgctgaaatttatctcttagaaagtttctaatatattatcactgtcagggattctttggcttggttcagtctgctaataagcttaggaaaggcaattttcattttgttgcaatatttttgatctgtagcttttgttgttattcttgttcatttttcaaaccagggtttctccacggctatactggaactctctgtagactaggctggcctcaaactctcaaatatctcactgcctctgcctcccatgttctgggattatatccctccactgcccaacagcatttattttattcttaagatttgtttttccctgctcgtttgtttgtttgtctgtttgtttggtatggtcatttgtttgtttgttttgatgtatttgaacttgctatctttatgtgaggataagcctaagtgtgtaatatttctgtactcatctcccaaatgctgaaatgtagacacgaaccaccacacactaggtttgtttggttttcttttgcatgcatttattgtattgtgtacagtactggtaccaaaggagtccatcacattctctagaacttgaattacagatggttgtgagttgtcacatggtgctgagaattaaacttgatcttcttcttttttaaatttaaatttcttcacttacatttaaaatgctatctgaaaagtcccccattacccccccccctcactcccctacctacccactcccactacttggccccggtgttccctgtactggggcatataaagtttgcaagaccaaggagcctctcttcccaatgatggccgactaggccatcttctacatatgcaactagagacacaagctctggggtactggttagttcataatgttattccacctatagggttgcagaccccttcagctccttgggtacttgctctagctcctccattggggaccctgtgttctaaacttgatcttctgaagagtaaccactattgattttaactgctaagtcatgtctccagtcccaaaagaggtttttttgtttgtttgtttttcattactgtgatgatcctataatgaagaagagaatgctggtggtttgtttatgtgtttgtttgttttttgagacagggtttcactgtgtgtccttggctgccctggaatttaagcatcagactggccttgatctcacagagatctgcctacttttgcgctgagattaaaggtctgcactaacacctcccagccagatgtctctttaacagactgactttacttcctcacgagtattatgatggtttcttcctgtcctgtgaggaatgctattgatttggggtttggtttgtggaatttttgttttctggttttttgtaatttttcccccctaaatatcatgctgtcttattctttggttaatttttttttgccatgttttcatttattatgagattggggacacagcatagaatacatgacaggattagagaagagcttgtaggggtctgctctttttctaccaattaggtacagggatcagtgtcaggtgtgacatagaactgaacttgaagtatcagaccaagaaaagcaatacacgttccatcctacccatgaggttgtaagagttgaaatattttttgataccagtgaattagaactgaccatcattttctagagctaccttagcttcaatctctgtcaaagccacaaagatttcatagctgatgttcttcaatgttcccagctaccagctcagtgcagtcagaacacgtattccttcactaatgcgtaatccatttagccaaaacttaaatgtagtcctctctttttttctttttcttcttcttcttcttctttttttttttttttttttttttgttttttttgttttgttttgtttgtttttcgagacagggtttctctgtgtagccctggctgtcctggaactcactctgtagaccaggctgacctcaaacttagaaatccacctgcctctgcccgagtgctgggattaaaggcgtgtgccaccaccgcctggcttccagatgttttctgaacattaatcaccagaagatttgggaaacaactgcttaatgtgaggtttatataaggcatctgacaatgaaaaaggaaatacgaagaaacttgactacagtttcctttagcacttttagcacaatatcaaaggactttaggaagtccaatcaatgttctagaagttttgtgagatcagaatcacaggaaagtcaacagatacaagattaataaaaggaagaaagagtgaaaatatgtctttgcccaataataattttagaagtaaatatagtaccaatgtccattaagtagacacaaaattgccataaatggtatcaaagagtggaatcatgatccagtcttagctatgttgctcagtttgtagtcttttttctagtatatatgatgcctgagattcaatctgcatcattgcgtaaaataaccactccgtataaccagaaccccataaaattgatagtggtgggacacacctgtaatttccgaactccggagaggtatacacaagaatgccagaagagaaattcaagataattcttgtctacatagctattttgaagccaatctatcctacatgagtatttgcctcaaaaaaaaaggtgtattccttatttagaatttattctgttcatttgttgactttttaggtgtgtgttttgttttgttttgttttgtttgtgaatgggtgactgttagggacaagctggccccaaacttctaagctgtgatatgacaggacagcagaagccatggggtagaggtttgacctaggagacaagatgtgtttgctgcaaagggtagagccagaaatgtggatgaggccctgcggctcccagagggttgtacacatcaagcatcgcatgtttggcattgctgaaatgtttgttttcttgctttgattctttgttcttcccttttggaatagaaatatgtgcctctttcttttttaattttcaggagccacagttcgcttattttaagagatatcttgggaatatacaaacagacatatctataatagttctatctataatagttctatctataatagttctataacatgagcttgtaggcaagactatgagacattttcttgtttattgattgatgtggaaggacctaatgagtggtgctatgctagtcaggtaggactatatggtatgataatgactgttttctcgaagtgtaaaatgaaatcaagccattcatcctcaatttggttttggtcatggtattttcttacattattagaaaccctaattgagccgggcgtggtggcgcacgcctttaatcccagcactcgggaggcagaggcaggcggatttctgagttcgaggccagcctggtctacagagtgagttccaggacagccagggctatacagagaaaccctgtctcgaaaaaccaaaaaaaaaaaaaaaaaaaaaaaaaaaaaagaaaccctaattgaaacacccactaaaccatcttgccagccctgaccttaagtttctaatcctgcctcgtccttattgatactagaattaccacacatggttcataccatacttgggatcaaacccaggggtcatgcctggtaagcaagcactgtttctactaagctacactgcctgcccctaaagtattgtttataagcctttataagtattatttattaacctcacacttaaaatgctaagataccgtactgtgtatctgtttcctcgtgtaggaatctaaaagtgaacatatgaggctcgaattgggaagccacccaagcatgaatatgatttaccaggctatcgggccttgccatggctaccctctacacatggtagagagcatgctcagcctctgcctgttgtccctcatcttcaccactgctgcggtgataaccaggaagccaagagctagtccggccttgcaggccatgataaagccactgcaccttagaagttatcatggtccaactaaaaaatgccaaaaacaaatgggatgtttctctgcagtatcctcctaatattacaatgaagtttgaaaaggtatatggagacccaggcagtggtggcgcacacctttaatcctagcactcaagaggcagaggcaggcagatttctgagttcgaggccagcctggtctacagagtaagttccaggacagccagggctacacagagaaaccctgtctcgtaaaactaaaaaaagaaaaaaaaaaaagaaagaaagaaagaaagaaagaaagaaagaaagaaagaaagaaaaggtatatggcagctgagggaacctagccattagtcttttattccactgtggaatttcatttattttgttcccttgtagctgatgagttttaagcacctaaaacaaggtacctttccttcccacccccaaactgaagactttcttagaagcagggcatgcacaagaaattcctgacgttactaccttcctatcttcacagtttaaaagaataaaggaaatggctgccgaagaggtggcctaaatcctagcatggcctgcccacaggcaagctgtgactgatgctgcggcaggtttacagtctccctctgtgacttgtggcacattctagccctgtggctgagtctcatgccaggatggctcagctccaaggcaaagccccatagtgttcattgaagtctctcacccactttgctttctgggatgggcatggatggtggcagttctttcccacctaataggaaaaagcgactgccaagtaagtaacccaggccctttgtctagattatcccttgcttaggcagaaccaacaaaagtttatactttaggtttttcaaattagggtttttctgtgtaaccgatatcatcctagaacgcactatgtagaccagggtggacctgagatcctgagttaatcccagatgtcttgtgctgggattaaaggcatacacctcggtgcccagctggacagattcttatgactaatcatttcttctttctgcccaaacccaaacaggccccagagtgacaagtccagccacccccactccttctttcctgtccacggatgtttaagcagagagagggaggaaggacaaagcaagtttaaaatggaaactaaaagggggaagacaaaaaggaatgggatagtggtgaataatcaaagaataaatacagccaagcagggtggccaactctactcactgcccttgagcccatttgctggaagcattagggttgacagcaacattgaagaaaacaactgtgtgcaaaggacacagtgaaatcaaaaacaaaaacatgaacaatgccattccatgcttagagggaattattttgttgtagataaaaggctgagaatagcaaaaagcagctgggggactctcctggcctaaagtgggggagaaggaaactggctgttgccagggttttgagagtagagaagattagctggaagagcctggaactagtgcagggcttaaaactgctagcggtttgactgaattccggaggttgcagtgaggaaggagcagataagagggtaatggcttttcctggcaaacaaagcaatttcgaaaggttactgaggaatgtggggtgtttactgactgggtcaaagtccagtctgagctgaggataagaaggttcggacctgaaatccactatagcagttgaaagcaacatgtctgtgattttctggggctattgtgggtctgtatgctgtcggtaaagtaacttcttcccatgcaaaactaataagatgctaggcaaggagccatcatctttttaaggtattgtttgataaagagtacagctcttctgctcgacatataaaacagagagaagtggaagaatccctcttttatttaagtgtacccaaggggtagaatctcctcatgcaacaccccctggagtctccagatgtggaggtctgtggaccatagcaggagctttctccaatgtccaggcaatggtccgagtccaggattctgtgcagttgtttgagcagccttccaagctccttccagtgtctgcagaaagttgctgaggaatagggtgcatctggcacaacttcaggctgaacaaacctggcatgtatatggtgctcaaagttcccatcacccacaagggagaaagattgccgtgcgcttctgctgtggtacacagaggaaagaacttgcctgtgtttctgtgagctccctatagtccagggagcttctctcagggtttagctgtgtgtgtggggggggggggggttgtgtgtgtgtgtgtgtttccatgcctcagaagcaagagctctgtttctccttttcatccctaggctttggaaaagtgcaccaccttggtgtatgtacatggcgctggctgcctgtgcctttgctcttgttccacatcccactccttccttccctggtaccagtgcctctctctgatgagctgatgaaagctttaatccctagctctcctctgtgtggaggcttcccctttgagggaggcagagcagctgcattcagcctggctggggagctgccagctgcagctcctgctctggcctctgctggtggctgcagtgtctcctcagagggtccctcccctcaggcctgtctccgctcctgtattgtgctcctgctcttaggcagcagtactgaaaagcctcatggcacaggcagaaggcctgcccctcccccgccccagccagacctagcttttcttcctaggcagggatgtgacaaaaggcttcatcttcatgcctgctctggctctgtcaccagcacaggccaggaggctgtctgctgggtggagatgctgcctttgagtatgtgtgttaggggctggggcagggagacagttatcatccagaaacccagatgtggagctggacaaccaggacatgaggggcagtgggcctacctaggggcttacaggccagccccagcaatacagaggaccccgtagtcaggaaggagaagccaccacagagaaaaaagtaaaagaaatactgccttggcacatactgttcctcctcccctactcagaagctgtgagacgggctccttccttttttagttggccctcctactgaaacagtgttgttcctgttctgagggacagactgaaatcagtgcaacaagcagccttccttagggctctgagtgcaagtgtcagtgagagtgtgtgcaggaactctccactgcagcttttttttttttttttttttttttttcagtgcaacaagcagcctttgtgtctatccagagcctcatgctgaaagatactgtagcagccaggtatctgtgtctttgtccccacattcttttcagggctgatgctcagaagtgaggtgcctctcccccacttgggtggactcagaagacagaggattagacaaaacctttctctctctctctctctctctctctctctctctcatattgtactttgtgtgcatgaaggtaaggaatcacgtcagcttgtggtcatttttctctttccaccacatgtgtcctggatattgaattctattcatcaggcttggtagcaggtcacaagtcccattacccactgagccatctcacttgtcctaaacaaagaggacattagagccttaacagtgagcagagtttctccttctactttttggacttgcatggaagctgggacttgaacagaaaagatcccccataagagcgtgttccagcgtccgtgctccagttgctggtgctgttggtgaaggttgtggccaatccttggaaggcctgagtcaatgtgtgttgctgacttggacaccgccatgtcaaggagcataggctcagccccatgcagtggccaggtgccctccccatcctcatgcaggtcagaggaatgctaaagtcttccttagggctctgagtgcaagtgtcagtgagagtgtgtgcaggaactctccactgcagctttctccccctgagtacttatggcctgaagactggtgccctacagacactgtgcctactgaaactagatcaacctctcttcctgatcagctgtataccacaattcctacctccttgcttatcaccaggcaataacccaccaccccattggactctacataataaatgtgctgtccttccaggctgctgtggtttctccatcagtatcctgttcacccaactccagcttgcctgtgtgtcctcttgtctatttattccctgactccccccctccccaaatcaggtcagtccttaaagccatgtaaggatgtgacagaaggttatggaatcttttggaggtggcatctttagaggggacagaaatctcttggagagagtgctttaaggttttatagtctggccccatttcctgtttcctttgcttcctgtgttgggagaaactgtgatttgctggcttcctgatagccagggcaaaaagcaaggtgctcctttagaaatgcacaaagacaaaagagcaattgggagagattataagagtgttcaagtacaaagggaagacagtgtgaagccagatcctctctatggtcacagcaggacccaacctttcttatgctttagcctcagatgactggcctacagaactgtgtgaaaggaaatgttatttgatcgtgtgtttgatggtcttgcagatcaatctctagcttcaatagtgttccggttaaaaaaaagaaaaaagccagggagcaacagaggagtagtagggtccgcctttgataccaatactccgaaggcagaggcaggcagagctctgtgagtttgacgatgccagcctggtctacagagtgagttacatgacagccagggctacacagagaaaccctgccttgagaaacaacaaatcagagagcagagccttcctcattcttccactctagtttcaagagggaactccttgaaccatcttcttggtcacctatttcctgcaccagctaacatgcgttttgtgtgtctatggttggtcaattcctttgctggcctaccaggggcttccacacccatagcaattgtctaaccaaggcatggttctgatggagaagaaggtacttctgggaggtggctaaggagcataaaggcagtactctgttctacaatgtgtaggagccattttaagatgaatacggtaaaactctgagtgccatgcttaaaaaactttgagaagagcataaatctgttcgtttctggatgatggaacctagagctctgtctcacacagagctcaatctttatggattcctctatatttaagtcttaggttagggaaaagtcaagaaaatggccataaggattggagagatgcctcagtagctgtgagcactggctgctcttccagatgacctagtttgaattctaggcacccccatggcagctaataagcatttacaactccagttctaagggctctaacccctcttctggcctcagctgacacttgtatacatgtggtgcacagcatatatgcatataaaacatacgacacattggaggggttgggggagggaaggctctcacgggaccagccgccataggcttcctggttcccaggcctactcttcctcaatagcttgtcttcacgaatgatgttctggaggtatcacatctcctggtgagacggtcagttttcctgtagggttcatgtcttgcttccacctacatgattggtgtaaggtgagagtaaaggctaagatgaggatggggagggacttcatttggcattccagagtaactattcaaatgggaaaatagaaaccttacgattctcagtgactgcaggatgccaaccaagagcctttgggatgtgagccatgaacccaaccaaaacccatagatggtagggtatgacaacggtcttctgaaggagtctactgggagcaggccgagggtgaatggcagaggcggtgggtgttaagtttctggggcagcttaaagacaggaagcagaaaaagagacccatctgacctcataagatggggccatttatttcaactattgaaggaaatatccagagtaaggaaggggtgtcttcgaaagagcgaggtatacttgagtttatacttgagtttttacttgaggtttgagaagtactactggatctatagcagttgcaagcctgaagtttctccctcctggagttgtttgtccagacaaggctgttttatctttaaaaactcccttggccctgcctattagaatgggggtcatggccgggcatggcagcgcacacctttaatcccagcacttgggaggcagaggcaggcagatttctgagttcaaggccatcctggtctacaaagtaagtgccaggacagccagggctacacagagaaaccctgtcccgaaaaaacaaaacaaaacaaaagaatgggggtcataatgggcactgagtttggcgatgatggggaagagctagagtttcaatatagggctttttggtcagggactagcaatgtttttgcttgttaacaagtgttaacaacaaaggcttgttaacagtgtttcaaggcaggaaggagtttcctggtgaagcaagtctctggtacaaatgatggaattcttaaagcaagaacgaatttcccgcctgaagtaagggctgagtgttttagagcagtagtggaaactccagataggggcatgcagcgcggtgtctctagcaggcctccagagctcccagccgctggttgagccagagtctaaagtcttcggaagaacatctagggagtttggccctggaaaaagccagttggctcagagctacactaggaggcagattgcagctgggctgatgaataaggctggcttattggctgtgtgtgtgcgcgcgtgtgcgtgtgcgtgcgcgcacgtgtgcggtgtagtgtggaataaggtccaatgagaagaatggctgtcagctcaggaagtataaaaatagaatgggctttcaatccgagctactgtatgtcccctcttctctctccctcctctgtgttgcaacagaaggaagtgtgagaggggatagaaggagagagaggaggtgaaagctggattttcacatctgttcccacttttggattgcagaaaccagttgtggctgagtgggtgggggagcagatgggggcagtgcaggattgagttttttgttttttgttttaatctctggctgccaactggaagctgcagtcatttgctgcctccaattatacagactgtcagcacagtctgttgcaggctctcttccagaggaggcttcacctccatgagaccccaaacatcactgagcacccctcctatattcgcatcagcacttattcctgagcctctccctccagcgggggcaggttttttgtcaccccaagtcctcctctacacctgaaactgagtgggaataatgagaatgctttttaggaccgggcatgtagcccagatagaagagggctagcatgcacaaagtcctgggttccatccctagcaatgtatatgtaacctgggtgtggtgatgtgtgcctataatagcggcactgagaaggtaggagcaggaacttaagttcatattcattcttgactgcacacacagtcagttcaacgtgtgtacctgggatatgtgagatcctgccttagaataaaatgtgagagaggggagagaaggggagagggagggagagaaaggaggggagaatttgcacaaaataagcaataaaaataaaagataaaagccactggttctgtgatgacttgttatggtagccttggccaatatatccttttggggagatagtagacatttaaacatgtttgaaaacctgacaaggaaagtgtcaggaatttatcctggcttcctaaagacactagatctcaggttgaaggaggtgtacaattcatttaggacacatagacacatggtaggatggggctgggggataaatcaccactaaaattcaaaatttttaaatatattggacttgccgggtgatggtggcacagcctttaatccgagcacttgggaggcagaggcaggcgaatttctgagttcgaggccagcctgatctacaaagtgagttccaggacagccaggctacacagagaaaccctgtctcgaaaaaccaaatatatgtatattggacttaaaatgtgttgccacttttcctgagcagagatgaacacacatcagttcatgccaggtagggcaccgacatcaacagagcggagactcaacccatccaagtctaccgtggcgttgcaatgagttttgggtagggaggggttaataggtgacagctcactgaagctgtatctctggactctctagaacttgcatgtaattttggcaataaatttgaggctctcaagaagagagtagcagttgtttacagtttttataattttggggatggatcttacgaaccttctaatttctgagcttcctgtgttttgtgaaccaccctcttccctctaggacagaatgtttcaattccaaggaatacaacgttacaacgtaatattcagtgtgccaactcaatcccactggaagacactcttaatctaatgccatacttccatgaatttcccaagaagggtagatgtcatcaaaatcatatgcaaattcgaggaagttgactcagcaccctgtgtgcagcacatgaacttctgcattggagtccacagcactcgcttggcgcggagagctatctgtaatcccagcactgggctatggaattggacacgggaggaatcctggagctcagcctagctgaatcagatagagacccaagactccacaactcaaaataataataagaaaaataataataaggtggagctgattgaggaagaaacccacacaaatgtacatatgttagtgactaagcaaagcaggtactttcaaaaacagactccctgttatgtattaaatgtattaatacataaatacatactattaatgtattaaagcttccctttattttctgctaaagccttatggtgcaagcccacaggcatttctgttcatctctggaatctctgatatatgctctgagacttttgagctacacagcaaaaatgtatctactatcttttcctttgaaattgtactctttttttttttttaagatttatttatttattatatgtaagtacactgtagctgtcttcagacactccagaagagggagtcagatctcattacgggtggttgtgagccaccatgtggttgctgggatttgaactctggaccttcggaagagcagtcgggtgctcttacccgctgagccatctcaccagcccttttttttttaagatttatttatttattatagaaattgtactcttaaactgagctaggtctggaatgtattcctaaactcaacctgcttaggaatcagcaatcttctctctgactaggcgtggacccctgagttgagtctgcatgcttctcttgtccatggagcatcactttgggaatgagtgctttaatctctttgcctactgcatggaggtaatagttatcaactttttttgtattttggctttgcatcccccaaaatgtgaacctattgtgtttgattatgcatacaccacagagagagagagagagagagagagagagagagagagagagagatacataatagttgctacaaattgatatattctatcttgaagggaagatcattaacactcaaggagttcgcccatcagtggtgatgcacacctttaattcagcacttgagaggcagaggcaggaggatttctgagttcgaggccagcctggtctacagagtgagttccaggacagccagggctacacagagaaaccctgtctcgaaacgccaaaaagaaaaaagactcgaggagttcaaaagggagtcttattagactcaggaagcccctgaaaactccacagatgtgccatgcccccataaagactacctagggacattcttgagccagccaagctgcctggaagaggcagagagcagccagtctttgatcttccctaacctgtcaagtatgtggtgcagtgaaccatagcatcccagctttcatgaactatcatccatgctggggctttggtgatgcagctgccattgagtcaggcctgatcctatacgtaatcccttgcccatactcctgtaagtaacctcaataaaaccctttgcttcagtaagtaggacttcggtgatatttgtacttgtgcatatatatatatatatatgtgtgtgtgtgtgtgtgtgtgtgtgtgtgtgtgtgtgtgtgtatatatgcaaagctgtttgaacttactaaacaggtaggtagaaaggatatgttatgtacttttgtacatggaagtagcctgaaaggctgttgaaatgagcactgaacaaaactgactgagtacatctgtgagagtcataaaaattattgattatatatgaatggaactggtaatagtatttattgactgctattacagtcttaaggctgtgggcccacctatcaaggtccctcttccaacagccaatacatagccttaaggttataatagagatgtcctttaatttacatttgtcgagaaatgcatgggtgaactaactgtctttctttctttctctctctctttcttcctttctttcttttttctttctttctttttttcttctttctttcaaacattttctttctgtgtagccctcacttgtctggaacttgctgtgtagaccaggctaaccttaaactcatagagatctgcttcagcctcccaactgttgggactgaaggcagaagccacatgcctgacatgggttatcattatatcaagccattttataagtgctaaagacttatgccaacttttataattcatgtgagaacatttatgtgtcacataaacattttactacattaatgttatacctctggaaaatttagtcaaagaaggagctaaaggtcagcttttcaagcacacaattttctatatattatatttagttaccacttaaagatgaggtggatcgaaatagctatagatttcaagagtgtccgggaacaaatatcatttgagcaaagttgtgattagtactgtgacttttgtcacttggaacagcttcacatttgtcatttaacttgtaacgtaccttgtaaagacacaaaagcccgcgaagacctggaatgaagcttggtgaaagagacctttccttgcatttaccacgcccagcatggcataaaaaccaaaaccaaaaaaaaaaaaattaaaaaaccaaacaaagaattcgactatgccctctgtttcttattcggtggtttgctaataaattaatagctaacctgatgtccctattgtgcttgttcaacctggtgtttactcagtagtccaaagttcaaagttctctttccttacctgtggcctagaagctgctttaagctgctttctaattctttacttgtttaaggtctgaagtttccagttctggctgtgtttctaagcagggccacagccttcagaagtagcttccccaaagcagaataatgggccctactccctcctttttgacctatgttttctgcgaattaattttttttctcatctccgtttgtatgttcaccaaccacattcctgtgaatccaggtgacctcatttatgagtggtaacctctctcttgggttcctgtctaccaccttctcagtcagtgaggcctcctctgtaaagttccctaagagcttgcacccttgtttgaaacagacccaccagctcaagtattgtttggaagtcctcctgaacactctgcagaggaaggcattgtccatttctgtagctggcaaccactctggcaggcactctttctatatacttagttggtgaggagaatgtctttggaagaggatgagtctggagaaagttaaacaccattaagaggtagtcatggtagctagagcttgtaatcctaatactcaggagacaaatgcaggattatagcaaattcaatgtaatctttggctacattgtgatttttctggtcagtgggccgccatagaaagaccctgatttttcatgtgtatatatgcaaagagacaccatttaaagttgttggccaaaggacccagatatagctctctcttgtgagactatgccggagcctagcaaacacagaagtggatgatcacagtcagctattggatgggtcacacggcccccaatggaggagctagagaaattacccaaggagctgaagggatctgcaaccctataggtggaacaacaatatgaactaaccagtaccccggagctcttgatgtatcaaaagatggcctagtcggccatcactgcaaagagaggcccattggacttgcaaactttatatgtcccagtacaggggaatgccagggccaaaaagggggagtgggtgggtaggggattgggggtgggtgggtatgggggacctttgggatagcattgaaaatgtaaacgaggaaaatacctaattaaaaaaaaagttgttgaccatacctcattgatagcctagagaaagtatgctttgtcccttcaaagggacagtggcaactggaaagctgaacagagcaggtaaggaagtctgttctttaagattcaagacaacacaaggattatatgtgaagaatgcagtgtgttgtgttttataaaactaaaaaaaaaaaaaagaaagaatatgtatggtggatgtatagtcaggtgtgggggaaggggctgcctttgtgggcccatgctgaggcaccctttactcctgagggaccagccacatatattcaggttatgggaaggggaattgagggagtagagacagagaaaggaagagagagagggagagagagagagagagagagagagagagagagagagagagagagagaagcagaccatgagccaatggagggggggaggggaatgggggacagagaggagagggagcaggaacaaggggtcagagcaatagcaagaaggcaagaaagaagagtatagtgaggagtccggcatctattgccaggtaactgtggggcagagcctagaccaaaaaaagaagaagaagaagaagaagaagaagaagaagaagaagaagaagaagaagaagaagaagaagcagcagctagcacagtgtgtgaccctaatggggatgccagtgtgggtaacctgatgaatgtttgtccaggtacagttgagcaattgttaacattaagctatctgtatatttcatgtatgtggtacattcagaaaagtccattgttacccttctctctctctctctctctctctctctctttctattctatcttttttgttgtttccttttttgttataggatgggggcagtttcaagatagggtgttttctatgtaactctggccatcttagaacttgctgtgtaggcaagactggtctcaaactcacagagatccacctgcctctgcctcctgagtgatgccaccacccaatactatttaaaaattttttggccgggcgtggtggcgcatgcctttaatcccagcacttgggaggcagaggcaggcggatttctgagttcgaggccagcctggactacagagtgagttccaggacagccagggctgcacagagaaaccctgtctcgaaaaaccaaaaaaaaaaaaaaaaaaaaaaaaaaaaaaaaaaaaaaaaaaaatttttgaagcttcacaaattcttttctacataatttagaatgcaaaacatgactttcaagttgcacacaattacataattttctaaaaattaagatgcgccaggcgtggtggcgcacgcctttaatcccagcactcaggaggcagaagcagatggattttttagttcaagaccagcctggtctacaaagtgaactccaggacagccagagctatacagagaaacactgtctcaaaaaaaccaaaataaataaataaataaaatttaagaaaatgcaggttgaggtagaagttagctcatagtaggcagtgttagcattctgtctaagctctaccccacagttacctggcaatagccaggtaggcctgacccactataaaaggggttacttgccccctccttgtcctcttacacttctcttgctctttctctgcttcccttcatccctctttccccatccccgcctcccccgcctccacatgctcatagctggcctctactcctctacttctcttctcttcttctcttctcttctcttctcttctcttctcttctcttctcttctcttctcttctcttctcttctctcctctcctctcctctcctctcctctcctctcctctcctctcctctcctcttctctctctctctctctctctctctctccccctctgactttctctgcctctactaccctcttaactccactccccatgccctaaataaactctattctacactataccatcgtgtctctggtccctcagggagaagggatgccttggcatgggcctgctgagacatccccttcccccacacctcaccacacccccatagaacaaaatcccccttctctttatctttttataaacacatcaggcagtaagaaaaagagcctacggtgaaaactacaaattattctgtgtgttaccgagggaatggatattaaggataaaaggcaatgtaagggttaaaatagcagatctagaagcaccaagaagagacaaagaatgagagagccaaataggtcagagaagaaacaaaggggctctaagaagcaagaccagtgacaaaagctggttagcagttagcttagcttttttgagtcctgtccccttagggaagcaagaacatgctaggtagtattacacattatattactgcttttttgtttgtttgtttggttggttggttggtttggtttggtttggtttggtttggtttggtttggtttggtttggtttggtttttcgagacagggtttctctgtgtagctctggctgtcctagaactcactttgtagaccaggctggcctggaactcagaaatctgactgcctctgcctccctagtgctgggattaaaggcatgcaccaccacgcacggctatattactgcttttaatgcatcatctctaatggagtaattataatcgactaagttgtaaataaggatagcttctaacaaccccctgccctttcaggaaagagaccccagaccatcctttagtagacaaagagaaaaccataaacactgcagctgcttttgtggcaagtgagagagcaatgaaaacataattaacagccgtggaacacctgcaaggtcaaaggtagcaacgtcagcagacagtcaaggacagcaatgaaaacagccagagagctttactataattatcagcaagacacctgcaaagtcacaaggtagggatgttgaccaagtaaaaaacagctagcagatagtcaactaagataagtcaactaaaataatcaactaagccagagacagagagggggctggggtgggggggacttatacccatcctgactgagcatgacacaaacatcaaatgatcagctgttgcttagaccaggcagatatgcataggcatgtagatcctctattgtctcagtcccttatgtggcataaggtcttctatatggacttgtccaggagctccttcgtcaggtacttacagtgacctaccaggagccaagaaagacccctatgaagctttctgagagttttcatgataggaggagagagaaagggggttaagcctctgatcaagtcatcacaaacacaagatagggatggaaaaccaggtccttcttccaggaagagggatgctaaaagacctgagaccagtaagagtaactctcccagataggcctctggcacacatgttccagtaatggaaagataatgcttgaacaaaagaaagcagatgcctctggtggagggtttcgagatatgggacaacaaacagatcaattgcatctatttctgggacccaactgtatacttagcccaagttgatgtctttctagtgaagagagctccaataatagtagtaatagtagtagtagtggtagtagtagtggtagtagtagtagcagcagcagtagtaatagaaatagggctgataataggagctgaaatgttttgaccacatgacaagtcaaaagtatctcaactctcattccaggggttccaacttctgaccccatcaggcattcatatgaatgtggtaaacagacatatatgaacacaaaatacctgtacatgtaaattttattaaacatttttttaaagttgaccgtacatagtaagaaagttacagaagatttgagtgtggatttgttgggaaaagaaattacttttttggctaactctagggatacgtatttctctctatcttaactagaacaggaacatacgtctctatatatgactggaattacaggcttaccatataaaaatttctgactctgcatttgcattcctttcaacttttcttgttttcaggaactattccttcacttcaagctcattgactcttatgctgggatgaattttttttctaactctcagactaaaaacaaacaaacaaacaagtaaattccaagtaaagaagtggctttcttaccctatggaaacataaaagaacttggatggataaatatgtgtgtcctgaattttcttcccatggatttcctccacatcatgagtttggtgattatgacacactatactatgaagggacgatctcactgaaggactccaagacaaatagtgaagggcagtgttccaggaaactgtcaggaccttccatgtaacgccccagaattcattcattcatcactggaatgtatggcctatatgtatatgaggtttatttggggaaataaagagagatcctggagcagggcagtggtgactcatgcctttaatcccagcacttgggaggcagaggcaggcagagttctgagttcgaggctagcctggtctacggagtgagttccaggacagccagggctatgcagagaaaccctgtcttgactgtctcaaaaaaaccaagagagagacagagagagtgagcagagagagacagagagagagagagacaaagagacaaagagacagagaaagagaccctgggcacatttttctgttaggttagttacctagcctagccctacctctaaaccagagattcctaaagatgactcaaaaaagcacaagtagtaacatttaaaatttaaaataggcaataggggttgaaactgggtgtgttaagatgagtatctggctggaatgtatcaactattctgtcactattcggacactattattcttcttctgtggcagggaggccagaagcttgagtcatctcattcttgctcgggtggacaccagacaccttagggatgggctgcaggattgtcctctaagatgagatgacttagggaaacctgtgttctaaatctgtgttccttttgttcccaaccatagagagactgagccaaagaatgtctcctcactatttaaccttctctgacaggaagcaattagacctcctgtgtcctaagatggggagatgagctgaaattcttgcaaaatgtatctgaatgtaagaaggtctgtgcctctgaggagatgtgacaccatactagcctgagcattgccagaagagatatatggtgaaccataactttaaaatcttaccaaccaattggagcaggactaacactttggttcaattggctatccctttcactaccacacattgtcagtataccaagaccaaactcaatgatttcatccaaaccagaaatgtcattgaccctcaggtttctatggattccactagagttcaagaggggcccgtaattcagtttaatgctagaaaccaaatagcaacaggatttgggtcagcaatctaccataaataaaaatgtagaatggataaaggatgcattctaaactcaacaaagacttttaaattacacaaggatacctatacttctgaaaggtatagcagatcatctggaggtcatcagggaaacggcatggtaaattggctagccctcactgtgatatcagcacataaaggagaatctgtgatgatggcaggtagtaacgttgtacttcatttctgaaaagaaaacttctgatagcaccatacaaaggctcttcgggaactacctactatgctcaataggttaactgaaattatgacaggggaaaggttcctccatcttgtctcagttgtaaccatctgtgttccaggaattcaaggtcaaaatcgcagctaactgaatgttgttggcttctgttaatcagattgcttgctttactttcccctgcatctgtcaaccaagatgtggttttcctgtaatctctgcctttaaaaactcccataagagccagacatggtggcgcatgcctttaatcccagtacttgggaggcagaggcaggcagatttctgagttcgaggccagccttaaaaaagaaaaaaaaaaacaaaaacaaaaacaaaaaaaaaacaaaaaaccaaaaaccaaaaaccaaaaaccaaaaaccaaaacctcccccataaaatgcatttgaggctgtttttctctccacgcaatttctagatggcttaatacagacttttaattcagacttcggtcatgtgagtagtctttgggtctctacctatcaacaaatagaatcccactgagatctctttgagactttttttttgttgttgttgttttttcaagacacggtttctctgtatagtcctggctgtcctggaactcactttgtagaccaggttggcctcgaactcagaaatccgcctgcctctgcctcccaagtgctgtgatcaaaggcgtgcgccaccaccgcccggctctttgagactcttaccagtgtgaccaactgtagatcttggcacaggctgtgaaccagagtacctgcaggttcagaacctagggggttcaaaacctgaaactttccagggctctggaagagaagatcttggtgaatcctacattcctgtctaaagttccttcagtaagaatcatctagtctgtcacctcctgaggtcctgaggtaagtctggttaaagtaccttctgtttaggacataaaggaaaggccagctgtagccactgatcgactgtccagactccatgtgagacatgactggattctccaatctgttcgggtataagaatgtgtggtggtcaacccatggttgtctttaatgtgcttctctttctatatgtttctgcccgttctattttcctagtggatttctctggtgtgaaaatcacccagccccatatcacctccgcttaagacctgtgcagtcttggtacggacctgaatcctttggctctatcaagttgcccagagaaaccaaaaacctccacctgtcccactcccacagtgttcctttgttgcttgactactgctcagtgggtcccagtccctgtgtggaggcatctaagtggaatgcataaagagttggagaaagttccccaagcatctcactccatctgctccccacctcctgctctaggcagccccaagtaaagggaaagtgccacagggctgtgcagggatcaggtggggtgagggttgtccaccccttccgcttccatgatttatgtcttttaaccaatgatctgatcattagaaaactcaaaagccatctttccctgaaaaggagtaggaaaaaaaaaactgttcccaagccagatggggctactgctgccagacagactgtataggatgtgttttcccttctgtccaacacaaagtagactttaaacacttttcactagtttgtccatgaaacaaaagacattacacaggcccacctgtcaaagaactgagtggttcctgctagtctaatgaacaaaaagcccacatgttaactaaggccaggaacttctaacagcaactcacacagctgagctctcctccaaggaccaccagaattctggttgtctaatacccatgtgacttagtaccaggccctactcctggactacctttgagaatggtttgagagacctactaccatcagtcctaataccctcttgcctggtgatgaccatgatgttcatccatgactgtcatgagatgacatccccctgaaagatctcaatacagagctctacactaataggactgacttcgtttaagatgaaactagtcattacaggccctccagttctccataaaggctttctgtttaggacataaaggaaaggccagctgcagccactgatctagtgtccagactctgtgtgagacatgattggattcttcagactatctgagagaccaaactaacctccaagtccaccaccagtttccccttattcaagcccaataatactgcctgggtcaagtaggtagccaaaggggccttaacaggtgattctctattcctctgaccatgaaggtagttggtattacaccatggatccactacacccaggtgaagaaagccaaagccacagatgatgatgccaagtggactgtcctcagactctggacccattaaaattaaaattaattaaattaattaaaatttcaagcccttctactccctgccccctctgtagaccaggctggccacgaattcagaagtccgcctgcctctgcctcccaagtgctgggattaaaggcgtgcgccaccactgcctggcctcttcttgagtcttgtgtttggtataaatatagggtcctgattcagctcccactgccctcagacttggacctgggaactgaggaagacagggatactgtacgttagaagtagtgtgactacagacccactgacttaatacggactatcaatttggactttggttgtgctgagtggcctttggctctaccccacagcaaaattcaagaataaatgacccattttcaaatcttaggaagcaatgtcttggaaaggaaaaaaggataaggatttcagtcctaaaattccttgttctagttctagggatatagttagatatcccgtgaccccatacatacaatggttgttgatgcaaagactatgtaactgacaaaacattgccatcatctcaaaacaggattattgatgaaatcctcaaaactggcaagtcaggcaatgctaactcaatctgaggacaagaatgaaaatgtattgtaaatgggggaaattgttggaaatttaatgtactggggttttttctatcaaagggtgaaataagacaaaattctagttaaaaaaaattgtaaagaagccacttggcagaaactcagattcctccagggtcaacacttcttgaaataaaatatgtgctcaaaaccggagcaagcataatggctcctgcctttaatcccagcacttgggagacaaaagcaggtggactgctgaatttgaggcaagtctggtctgccgatttagttcagggattgccagggctagtaatgagaccttgcttggaaaataactcaaaaaacccaaaatgtgcttgacttcttcctccctggagaccgtgctgctctgtgtaggctaactataagaatgtgagcacgccaaggacgccacatgaaaccccacagaatcatcaaacagggctcatagaggctcacagagagattgaacagacaatcagggagcctgcatgagtctgacctaggcccctctctatgtgttatagttgtgtaatttggtgttcttgtggaacccctaagagtgggaataggggtgtctctgactcctttgcctgcttctgggacccttttcctcccacatgattgcctggtctagcctggtctatccttaatgtaaatgtttgtgcctagtcttctaatgtgtcatgccatgcttggttgagatccccggggaggcctgatcttttctgaaggaaaaggaggagtggatctggaggagaggggagatgtgggaaggactctctcggagaggagggaagggaaactcaggagaggagggaaggatgtgctatgaaaagaagaagaagaacaaataaaagaaaaagaaaagaaaagaaaaattttaaagatgcaaaagaccaaaaacaaacaaacaaacaaacaaaaacaagcaaacaaaaacaataacgaatgtaagcactcctagggaagcacacagcaccctttaccacagtaatgcagcacagtaatgcagtaatacagcaatacagcaatacagcaatacagcaatacagcaatacagcaatacagcaatacagcacagacgcctgcatcccactgcacatgctttcctgctgcacagggcaggactgtggacccttcagcagaaataaaatgttttgctttgctgaaatactttggaataatatggtcattttcttgcatgctgagagctgattgtgggtttggtttgctattctctgatgactagtgttggtgagaccctgccccacccccaccccccacccccacacacacacctgccatcacttgagaaatgtctactcagccccttcactaattttttaattaacttgcttgttttgttctggtttggagttagctgtccagcttccttaaatattctggatattaactcctgagcaaaaatgttctggccaatttggaatctggccaactccttagcaaagtatgttctggatattaactccttagcaaatatattctctgccagtttggaatctggttttgagtttgttggctgtgcaaaagcaagacaactcctgccactccaatgcacaaaccctaatccctgccaagaaccaatgttgagttttttcctaggagttttaagagttccgatcttagccaggcctagttgcataatctatagccccagctactcatgaggccaaggcaggaggctttcctgggctatagaactagatgaaggatgtctgggaaacatagtaagaaggtgtcttaaaattttaagttaaagaatgtaactccaaccagatatgcttacacacacctttaattctaacacccagacaggggcaggcagatctctgaattccaggccagtctggtatacagaggcagttccagaacagacatggctacatagaaaactttgtctcacgcaaacaaataaagaaataaaaaagggttgtaattctttggtagaatgtttgtctaagatgtgtgaagccctgagtttaatgaccagcacaacaaagactgtaagttgtacatctagtattttgcgtttgcttctctgtatgtttaccaagctcctaataacgaggccttaaatatataggcaaatgctggaccatagctccagccctgtttttgcttttctgattgtatgtgggctagggtggcccaaaactcatggtaattctactgcctaattgcccctggaactggatttactggcagaagctgccatgcctggttgtatattttggaatatgatacaccctgtgccctgttacttatgctccccttctgggagacactttctctcggtctgctctccatcccaagagtaaatgaaacattctatttatattttgcccttagcagggacctaaaagtaatcaggaaactgttctatattattctgagatctagtctgtatacccaaggaaagggtggtatttggtgtgtgatgggaggaaaggtttaaaaatgattctttggggaaaagttatatggcccagtcgctaacagagagatctggggaagttattctctattcctttctttcttcacctgtaaaatgagataatattcacctgcgttataggctgagaatttgtgctagccagttttatgtcaacttgacagaggctaggagaggagggagcctcaggggagaaaaatcctccctctgtatggaatttttgaaaatagtaactgatgatggagggcccagcccattatgggtaattccatccctggaatggtggtcctgatttctgtaagcagactgagaaagtcatgaagaataattcagcaagcagcacccctccttggtctctgcatcatctcctccctccaaatttctgccctatttgagtttctttcctgacttactttgatgatgaacagcgatgtggaagcataagccaaatagaccatcgcctctccaagttgctttgattatgatgtttcatcatagcaatagtaaccttaggttacatagaattaaacagtattatttaatctgttgttataaaaatcacatctgaaaaggaataagaactagtttattttggagttattttaaataaccatggccaagaaaacaaatttaggttacatgaaatttcatgttctgatgtggaagcagtttcatgaaggtttatagctttacagagcagagaaagttataaaactcaaggcaagtttaaaatatattgatggataaactagtaaggcaagtaaaacaagatggaaggtgataattataggcctaaaatacaagctggtagcaagcattcttagctactgaatggcagaagctagtgtcctgctaagggaatacaatggcctggcaaacaataggcattccagaaagctaaaactagcccaagacaaagtaattaacctctgaaccagcaaaattccaatctctccacaggcctgaaatcccaattcacccatcatcagtctctgcagacacagacacctcttccagaagagttttgttcatagagcaagacacagcttcttctcgggaatttttatgcacagataatatgaacacagacatctaagcacccactaaatagtactggtgatttaatgatttggtgcatgtgataaacaatattctccttgaaaataccagctcatctcctctctgggtgctaacaacagcctccactagcagcaggcttacactcagagagcgattttgggacactcatatttccgtgcaaacatcccaggtcacagatattttctggttttgactatagaaaaggagccactggcatcctgacagtaataagttgcagcggggaaggaagtgcgctcattcaaaatgcacctgcgctgcattaggccagggattacaaactgagctgggctaagcagtgtcgtgtttacaccgactcgggcagctggctcagcatgaggctctggatagacacaaaggctgcttgttgcttgtcccttggcagctgcagcggtggcagcagcagcagcagcggcggcggagcaggaaccacactgcttaactagcaagaaacctgtctcagagcctctcctctgaaagaaaggtgaagaacagtatgtgccaagacagtatttcttttacttttaaaacgccatctccaaatatccttgcataaaccaggtagcacaagaaaacactattttctctgtggtggcttctccttcctgactacggggtcctctgtattgctggggctggcctgtaagcccctaggtaggcccactgctcctcatgtcctggttgtccagctccacatctgggtttctggatgataactgtctccctgccccagcccctaacacacatactcaaaggcagcatctccacccagcagacagcctcctggcctgtgctggtgacagagccagagcaggcatgaagatgaagccttttgtcacatccctgcctaggaagaaaagctaggtctggctggggcgggggaggggcaggccttctgcctgtgccatgaggcttttcagtactgctgcctaagagcaggagcacaatacaggaggggagacaggcctgaggggagggaccctctgaggagacactgcagccaccagcagaggccagagcaggagctgcagctggcagctccccagccaggctgaatgcagctgccctgcctcccttaaaggggaagcctccacacagaggagagctagggattaaagctttcatcagctcatcagagagaggcactggtaccagggaaggaaggagtgggatgtggaacaagagcaaaggcacaggcagccagcgccatgtacaccaaggtggtgcacttttccaaagcctagggatgaaaaggagaaacagagctcttgcttctgaggcatggaaacacacaccacacacacacacacaacacacaaacacacaacacacacacaaacacacaacacacacacacacacacaacacacagctaaaccctgagagaagctccctggactataggatgtccccagacagctgacacaggaaagttctttcctctgtgtaccacagcaggggcacatggcagtcttcctcccttgtgggctatgggaactttgagcacctgatgaaactttaatttttttcaaaacctattttttttaaagatttatttattattatatgtaagtacactgtagctgtcttcagacacaccagaaaagggagtcagatcttgttacggatggttgtgagccaccatgtggttgctgggatttgaactatggaccttcggaagagcagtctggtgctcttacccactgagccatctcaccagccctcaaaacccatttttaataatggatggatcttagatgctttaacctcccttgtagactactacccaccagaagtactgggaaagaaagcatacagggaagcagacttttttaaaaggttctctggagcaactcctgtctgtgttgtctggaaatcggcagtttagtttacaggttagcagtggcagcccgatccactcgcagtgcaaacacttcactgcaaacacaaacaggtatctgcagtgatggcactacctagcagagacagccaggcctcagcattggcacaagtcagcaggagggaccttaagggacaccagaagttcccagctgtgcctctctcagggaagcggaaaatcatccaagactggagacccacacacattgtgcatttcacagctagctctataagcagtccaagcttggcctcaatcactgtccatcgagtcctagttataccctccaaacatcacgtgtcctccacaggtcttgcctcagtatgcgcacctgtctcagctgacattacttggccaatcagcccgagtccattgaagcaacaagaaactgcagcacactatgggaagtttttcggtatgtttctctctatggagtactgacaaatgcagctcaactacacaatgtaagctgggccaagaaatgagtgttgttagcaaagaatccttttttttttttggttttttgagacagggtttctctgtgtagccttggctgtcctggaactcactttgtagaccaggctggccttgaactcagaaatcggcctgtccctgcctcccaagtgctgggattaaaggcatgcgccaccacacccggctcaaagaatccttcatcatgtgtcctctagcatgcttgctttagcagaacatcctttctcctgtttctgcttcagctaaacattccttcacatgtttgcccctagcaaaacaccattcaaccaagtttccaatgaacccttaagtttccacttcaacctgatgtatgccaggtctgttcagactgaagctgtgacagagatgtactctgctccttagcgagtttctacagacattggaggagcttggaaggatggtcaaatcagctgccctgataactagaggcctaccttgtatatggacccagaccctgcatgcacaatatctaccagttgggcttcagtattacctgcgttcaagttgcacactctgggtgcatgaaggctcacattcagtgcgttccatcagatttaatagcaagagggcagaagggacaaatgggagatagaagagagtagtaaggaacgctggtcagatggtgaagagtcttggtccttatggaagttccaagtggagactttgaggttcgctttttagaaatgtctacatgacattcatggaaaggcagaatttttttttgataaataaaattattgcatttaatgttattttcttaaaaacccaaatcatcatatcccttaatgttgtaccaaacaatgccagttcaaatgatagaaaatgtatgtcaacagtacctgaaaacaaaattaagaagggtataaagccctacctacagtttgtctaatttacatcaagcggtcatggaaacaaatgatcattaaaattattttataattatgtacaatgaacaaaagcatagtaagtagcagggtacttttccaccataaaattatttacagccctttgttcatctagaaacactagcttgagaggtacttgtcaggtatattcctcttgaaataacttctctacagcaaacaattgtcttctatttggaacacattgaagaaaataattgtctcattatttttgtgttttgagtcttgattcctaatagttcaaggtattatgggagaatcctggtgtcctggatagctcaataacaaactgagatctagcagagtgtttgtattctgagaatactgtccagtgcatgcaaatgcttgcgtgtaggctgtgcgcccagactcacaaagcctgttaggaaagcttcacacagactttgctttgctccttctttatagggcgttgcgcttccttctccgttttcttcctttgttgttctgctgtctcttctctccgtctgaaattttctgctgcttcaggacttcttctgcttgccaggctgcgtcttcttcctcttcccatgcactggtattttcttgccacgtatctaagtcacctaattttgaagactgatgaataaaaggcctatcttgtgcagctgccaatctactggaaaaacctgtgctaccatctgggacaccaaaattcaatggttctctcttcttaatgacaattttctgagttttctgtatagttggagttatggcctcgaagtagtcaggttccagttgctccaaagagttctgctgtgttgccacaatcccattccctccttcgatgcactagtgggctcatcttcatcccaggaagtccactcctccaggtctgtctgcttagggacagacgaataatcaactgtggtgggcaaagttatttgatctccacttaatttccttcctctgccagatctgcacattaatctctttaggaatgagaacactattgctaggcaagtacaaactttaaagaaccgaaactgagtgatggccatggtgaaaaccagaacttgcccctccccctccccgcccgcctgcgctgcggaggctcagagctgccgcgggccgtgcgcgctcagcggctgcctgcctagagctcgcgctcagccatcttagtcccagctccactcattcaaagccgggcgcgcacacgcgctccgtcgcagccaccgtggccgccccttctccaaaattccccagatttttttttttttttttttttttttttgcaaaacccagtagttaagtacatatcaagaaattagaaactaaacttagtaaagaaatgagggctgtatatgaagctcagtgcagaaggccctggatgctaccctctactcgcagcgtggaaacagacacacgcacaccagcgcgaacacatgcaggaaggaaagagtatcttgaagtgtgaattggctcttggtgaacttctggtttctgaagaagggaagcatcccattaagtgcagccaatgcatagtacctatttgctcttaaatattctgtatttggtctaggtgttatagcacaaggaagtaaaaatcaatcttaaatgctcagcaattatagttaaacttaatgcagtgagatttaaaaaaaaaaatctccggagcagtggtggcgcatgtctttaatcccagcacttgggaggcagaagcaggcaaatttctgagtttgagaccagcctggtctacagagtgagttccgggacagctagggctacacagagaaaccctgtctccaaaaaacaaaacaaacaaacaaacaaaaatatctcctactaacagtagttagctagcatgaacagcccagaaattaatgctcatgtgtgtggtcgggttatttttaactggagtgtcaagtcaactgaattttgggaaaagaatagtcttttcaaaacaaagggttcaggcaaggctttatgtgcgtgtacaaaagagtgattttttaaaaaatgatcccaaggaccagggagatggcttggtaggtaaagtgcttgccatacaaaaacaagctcctggattcaaatccccagcatccacgtaagggcacacatttgtagtaatattgctgaagatgcagagacaggtggattccagagtcactggccaatcagtgtcactgaagctgtgaacttcaacattaaattagaatgtcatcaaggaagacatttgataccaatctctatcgacttgagtctagcctctatatacacatgcatacagataggaacacacacacatatcacaaacacatacactcaaatagaaggaactaagaatgcattaaagatcaaaacagaccagttaaaatcataagtgctaacaagaatatacattagacttggcaatgactttaaaacaaagttcagaaaagcaagagaatgggaatttaaggtcatctttactacagcatggactatattaagcccagttcctaaaaacaaaaacaaaaaacaaaacaaaaaaacccatttttatacaaatagccatgtgcagtggtgtgtgtatagctataatcccaccactttgaacacaggggcagaagaattgcataccagttctaggcagccagggttacattcccagactctgtctcaaaacaaaacagcaacacaaaatgatgaaaatgccctggaaatggtggcatttaatcccagtactcaggaaacagggttcgaggccagcctggtgtagacagcaagttccaggacagccagagctacacagtgaaactctgtctctaaaaccaaaacaaaacaaacaaaaaatatcacaaagccaggcggtggtggcgcatacctttagtcccagtacttgggaggcagaggcaggcagatttctgagttccaggacagccagggctacacagagaaaccctgtctccaaaaaacaaaacaaaaacaacaaaaaaaccacaaaaatgtaacctatagttgagacaaagtatttgatagctgtattattgataaatactaacaaaaatatatgaatggctataaatcaatgaaagagctctgaaaagagatcagattgaagaagcagttggttgtggttgcacacacctgtagtcctagagcactggtgtctaatgcaggagaacctcaagttccaggctagtctggaacatatcctaagcaccaggccagcttgaagctgcagagcaaaaatactgcctcaaaaaaaattgtaatcagatttccatactgtaccaatatattattcttcaaaataaatgaacatacaagtttcaaaacaggaatttcatactccctaacaaaaataaccttggataaatgtgattttccagaggagcacatattttgatgcttaatcggaaatcagtattccttttctgtttgatcggttttttgtttgtttgttttggttttgttttttccagacagagtttctctgtgtagccctggctgtcctggaactcactctgtagaccagactggcctcgaactcagaaatcggcctgcctctgcctcccaagtgctgggattaaaggcgtgcgccaccaatgcccggctgttgttttgttgttgttgttgttgttttttaaagatgtatttactttttacgagcattggtgttttgcctgactgaatgtatgcctgtgtgaaggtgtcagatcccatagaactgccattacaggcacttgtaagaggccgtgtgggtgctgggccccggtcctccagaaagttgccaatgctcttattcactaattcatttctccagcccagaaatcgttatttctaatgcatcatcacacgagatccaggatccagttcaatgcggatgtataaatggaggcaaacagaatcttaggctgaaaagtgattttttttaaagttttatttattctctcatgccatccatctgaaccgcagctttcgctccctctagtccttccggttcctccccgccaataacccccactgtgaagcatgaaatttttgaaaaggttggcaaaggccctgaacatcgcaacttgtgattggcttagatagcagtttcctaagactccctatagaccttcctcattgggtcctcacattgcctcgcctactttgtatctagtttcttttctttcctttgcctagtggcttgtgttttagcctccttgctcctccctactctgcttgcttcctctctgccctttctggtcttagggcctgaacagtaccccctcccggtcacctttctgttctgttctgcttggcttcctgctcagagccccgagtctcctcaactcaccgagtctcctcaactcaccatcttcggtcttcgcttcgaggtctccttggccccacgctctagcctcgcctcacctacgtaagatctcgcttcctaatttgtctgccctctacaggtttgtgctttgcccaagccgccatggaaagtgacttagtgggcccagagggcagccaggatgtttccagagtggagggaacagaggtcttgtcacccccactccaagcctctcctgtaattgccactgcgaacttagctgccaggcagggcaggtctacccagagcaggagagcacaaggcggttcaggattcaggcttcctggcccagagagggtggagtccaaccaggaagagcgtctcattcctctctcacagatgatcccatacatctcctgttttatttgcaaaggctacttaatagatgcggcgaccattacagaatgtcttcatagtttctgtaaaagctgcatcgtaaaacattttgaacacagcaacagatgtcctaagtgcaaccttatagtgcaccaggccaaacctcataaaaacttgaggatggatccacaattacaaagcatagtatacaaattagtggcaggtctagaggaaaatgaaaaaaagcagaggcgtgaatttaataaagaacattgtctgggaccaccagaacccgctgctgatccacagccaggccattcaagtgaagagaacactaaggaagttgtggaatagtgtcttagtttatgtgatctggtatgtctttagtactggagtctatgggtactaatgcatacactgaacatgttaagcactgaaaatccacgtttatctgagtctcaggaaatgaaaccactggacagagagaaacatttctcaaaaaaacaacaagctttgctgcagcttgtcagttgctgaaggactttcaaactcaaccagtacagtgtacagtagtgaatatgaggatacaggatgaggatacaggatagtctgctgccttttgttaaggtctcctctcagagtgacttgctacagctatcatgaaaggacagaaagtaagaaggcctctgcagaactgaatcttaccgaagagtcctagaaaacatagaatcattataagctgtactgtttctggcatacctgttttctgcaccagaaatcctagcgtttataggattgttacagcttagaacaatgggattaaaaaaaacattgacttttaaatttccttacgattccaagaactgtgaagttgaatgttgcacctcatcatcactgttgacagtttgctcttttgttgagcccattctctttcaagctgattgaggttctgctgtctgcggtggcttcagtggtcttccttctggaaaacaacatcccaggggtccaaagccagtcttcgttaaattgcaaagtaaactcacaaagactgactttttctttttttttttttaactacgtttgtatgttgacaccatattttgaagttacctgttttttgaaagtaacagcactcctgaagagatgttattccgttctaaaaggtaggaattactgtagtacaggaagaaattgtctctagtagggtgtatgacttgagccataaaccttcagacttaacatgtcttaagataagaggcagtctttgtgagatatatatatatagttaaatatgtattaacttaattgtatatgttatacacacactgtagttactacccatgttactggtgtagtgagatcacacaagatccccatagaataattgctgataccttgtgatggtaatggtgccaccttctgaaatagcaaagttccagttaactcataagtttctatattgtttctccagcaagtcacttttactgatgtaatttttgctgtctgtttccctattatttttgtcattgggatttaaaaataaggctgtttgtaagctaactttaatgtagaaacttctatttaaaaaatttttttctttgccaaaaattttacattttgatatttctaaacgatatcctacagactcttgtttcgcaaacattttaaatcctgtgttggaaactttaaacactggacaaacaatggtaattgtaaaggatttgggaactgtctggacatggtggcacatgcccgtaatcttagtacttgggcaaggagaggggaagatcaggagttcaaagtctccttcacctacatagggcatgggcaatattggcagctgttgaaacctttaaggagtgtgggggtgggggctggagcattacgagtgtgagcctgaaagtggattgtgagaccctgtcctctatttctggccatgagttgaacgatcccttacaatgccttgctaccttaccactgtcccagatcaacaggaacaagcagccaatggtgtagccgtatggaaactgtgagccaaatgaacattttctctttttagattgattatctcagttatttattcttataatagaaagctaatcaacaacattattttatatttaaaattgatgttgagaactgtagtggattattataattgcatattgttgtaatttcctgttaatacaaattggcctctctcaggaactactaatggtagagacattttctactcctctgtgtctctttccaggttttcagtgtgatgcatccagatttgtataacacactaatgcccacatccctctgggagatctcacaagcgcttgcctcacaggaagacctccatagctggcatccactgtgccaatagccacaagaaggacatcttagttacagcatggtcccgttgttgctttggcatccatgccagcatagttgttttcgccatttgggtttttgttttatttctgttgtttttgtctgttttcccctgcccactggttgagcagatgttggcctgtggttgttgtcttttctcttacatttaatataaactgattctgttacttcatgcatgtgcctctgtgtgttttgtactgcctcatttggtgttgtgctggactggcatgctgcaaagaaattctctgggtaaaggcttttttaaatagtggctatcttggtaaaaataaagtggacccaaaagtcctaagaatatctcccatatccacaaactctggagctccatcaaggcagggctccagggacacacctcaagttcaacttcgaggaaaagaaatccttgggatatcaaaaatgtgtatgccctttgagctgagagacagagcatgtgctcacgttcattttggcttagtgtctggccctctcacttggctagcactgtgtgggaaggctctcgggtttgctgatgtgtctgtgttgctgtctactgctgcctgttgtattgccttggtcaagtccccagtccccagctacattgatgggtctgaaaatgtctgatttctttctaggacccaatttgctgggttcatattccagtaagagtgaccacatgtcgtattggtctttttttggtttgtttttgttttttaagatttatttatttatttattatatgtgagtacactgtagctgtcttcagacactccggaagagggtattagatctttttacggatggttgtgagccaccatgtggttgctgggatttgaactcaggaccttcggaagagtagtcagtgctcttaaccactgagccatctcaccagtttccttttttttttttttttttttttttgtttgggtttttttgagtcagggtttctcggtgcaggtctggctgtcctgctggaactcactcggtagacaccagtctggcctcaaactcagaaatctgactgcctctgcctcccaagtactggaattaaaagtgtgagtcaccactgcccggtgtattggtcattttgtaacagagctgctagtagagttaagtcgagtctgttcccgaggttctgtctgtgctgtggtggcttgttccagaggcacaggggaaagggtgagcctgtaaggagcggccaggtagataatgggctggtgatttcaggatcctgtgcatccactaacttggtgaggggttagatgaggctgggattttcagcctggcaaagtaggagagtcacattcactaggaagacaaggatcctcactggccaatgtggcaatgtcttcccttgatgactccccgcccctccaataccctcctccgtgtcaaaagacttaatgctttgaatataaaggcagaaattcctcatcttcacccctgccccagggagcctgaagttccaggatggaaaagctgggtagcgtgctcagtgctcaggatgcctaaggaccttgtacaaggatcctgccctctgtgctttagggatggatggcttggcctaaaccaggtgagatccactgggtccctctggagaaggcagagactgcctcacattggatacagtgggacccacaaatggaagccatctatcactggtggagatcctggaaaccctacgaagttgttaggtgaatgtctcaagacaggaaacattcttctaagctacctagatatagaaactactcaagaaaaatccttacaaggataggtgaaggaaatacttttttttaagttctgtcattttggaggaagggtcacaggaaggctcctggatgtaggtaccaggtcccttcgtttcctgcttttcctcttaggaaccaggaagatcagggataatctgcaacttttaggccaaaagtcagcagtgggggatgggcacacacaaggaacttctggtgttctctgaacctaacgaagggggaaaaaatcctgctgctattgtggcctcatattcatgggcacaaaagaggaagctcaaactttgattactgaggaaacaccacttgcagggagcacagagctcctccggattacttaccattctataagcaaaccccgagagaggacaaataggaaggttaaatcatagctacatgccttttaacactagcacatgatacactatgtgcccataaaatagaagtaaactgtcaaaaaattacatacttcgattcaaaattggtttgagtactttccctggtttcagtttgaagaaccaaaccaagcaacgaacccacgatttaaatctgatctggcaaaagctgaggcttgcaggccttcagtttagtaatacatgccctacacctcacacttcaccaattgaaccagcaactgatgcatcgctacacaatcataacccagttccaggccctgactataggctaatgttctactttgtttgtgagataagtgtctctccttatgctagggcatcaatcagttggtttgactggctcttgtctccagcttctccagtgctgggaaggcaaacatgcatttgtgtgtggatattaggtgaaggaggctcaggggcggttaggccaaaatggaaagcagtctctggttgctccttgatccttttcctcaagggtgttggatctgatacagtttgctaactgaagggtgggcaggaccaacaatggagagatctgcctgcttttgcctccctggtgctagattaaaggccaccactaagccagtttgaactgcttgctctttttcccccttttcttccttccttccttccttccttccttccttccttccttttcttcttggttgttcaagacaaggttttttctgggtaaccttggccatcacggaactcactctgtagaccaggctggccttggtccacctgcctctgcttcctgagtgctgagattaaaggagtgtgccaccaccgcccagcctgctctagtgagaagcagaggggagcagggttctttttgggttgatttttttgtttcgctttctttctttctttctttctttctttctttctttctttctttctttctttctttctctctctctctctctctctctctctctctctctctctctctctctttctttctctctttctttgtctacttgtttgttgttgttttttttaaagatttatttattgtatatgagtacactgtcactgtttcagacacaccagaagaaagcattggatccaattacagatggttgtgagccaccatgtggttgctgggaattgaactcgggacctctggaagagcagtctgtgcttaagttggccacgatacaaataagctaggagatcttaagagtgttctgtatctgtctctgaactgcctggttggcggatatggagattattgctcaaatgggcaatctctctctctccctcccttcccccctctctctgtctctctctgtctctctgtctctgtctctctctcacacactcacacacaaacaccattatcatcatcatctcccaccacgcccgtactcctgcttgctcctatgtagtgtagcagtttactgggaacaaaaacaatccctcaaaggagaagggggccttcaggtatctcttgcgaatagaaatgtaacaagactctcaaaggcttctgcccagctttgcagaagtagtaaacaacagctggaagacaaaggagactgactagcccagctgtctagaggctagttgaattttctccaagtttttcagagagctccaaagataagcttttcctgactaaaatgcttttggcttggtatctgtaactgaccactcatccatactcctggtggtgaccccaattaaagctcacagctgcttcaccaagttggactttggtgcagttgttacttttgtctgccataggctccctttcttgggtcaagtagatgagtatgtgtttcattccccccaaaagtgtgtcacaacaaacttcagtgccccaacagggacctgacaggagcaaagatgagttggagaggagcaattgtgtgatcttgtttatataaagcaagccatacaattgaggccgagcaagctgcgggtggggtggatggggggtcatctaaggaggaaattccacaaagcagtctcctcactggaaaccaccacaacctcaatccatacggtgtgcgctagcgtgcctttttgctactgcattggtttcatggttcctgctaggagaggtgagatgtgtaactaaggcagagccatgggtggagtgtctgtgagagggatcccaggaaggcagtcttcaactctctggtttggggtagcatccctgcctgatgagtggaatctaacacttgaatgtggagatgcctgagaacagcgaaaggtttcaaatgttagtctttgagagtagcgcagaagggcagagagtatcagtagccagctatggaagttgctgggctgctgctatgagataaaaatgctttggggcaggaactgcagcccagcaggaacctgttggtgtaaaggaggaattataagaaaggcagccacagctagcatcctccatgttggccactgatttagcaggtgaatttgataaaagaaaggatgagttagaggtgttggtttgccacttattatagctggggaaagtacaggttatgtgagtgctgaagggcccttcctgggatccaagaacttggaacccaaggaaagaacagaagcatgagaaagaagaaaagaaagagactttggtaaaaatgagaaaagacacataggtctaacctttaatagaaaagatgagaaaatctgtgatccaacttggagggggacatggtttaatgatagtcccatacaaaagtacctttgatactagggactactcatccctgaagagcttgaattgaagaaggctttaaaataagcaatgaaagatcctgtcgctgcctggctcatgacactgggtcacactggagtagacgggatcagtctgactgctgtggagacagataactacccctctccttaagacaggggtttcgtaacctgaaattcggatgcatggtgcacagagacaacagaaaaaaagaacagtagttacctgagtctgggggtagaccaatttggcaaagattgcttaatggagagctgcaatttgaaataaattgaaaaagtttttgataaagactaatggtaatagctgtacaatagattgaataactctaaatgacaatttaatcttatatgtatgtcacaatgctaagcactttatacaaaaagacaagttatagactaggagaacatatttgagaagacaaattttagattacagacttacatctagaacttgcaaagaacacttaaaacttaatatagtcaagtcttttgcttactaggaattcagttctaatcaccaaaaatattatgtctagatgacatatatgatatatatgtgtgcatgtaatatatatatatatatatgtatatatatcttttattatcaaaaactgtcaatgatcatctaagccttccttcagtatgtcaatctttctgttgtcagaggaccttgcttcgggtggctggacagaatagaggttgttgaaagttgaaatgactgtgacaatgtctcaacatacaaacactgacagtgagtgggtggcacaggcctctaatctcagctacttaggatgctgatataggagggttgcaaactcaagatcaacttggctacagagagagtttaaggccagcctgagcagcctagtgacatcctgcatcaaaataagaaggagccaaaaaataaaataaatccatcataatgttggaaatcagtcataatgttggagacaataggcagagacaggcagatttctgagttcgaggccagcctggtctacagagtgagttccaggacagccagggctacacagagataccctgtctcgaaaaacaaaaacaaaaacattaggccttttctttagcccatgcttcaccatctttgatcattcaacactgttaaatcataggttttgaatattttggagaacagcttcctcctctggatccatctggcagtagggtttctctcagtcttctctcccatagcaggcagacatatagaaatatcagggcttgtcattgtgctggaggtcatcctcatagttaaggaacagcatcaaaaaggtcacatccaatcagaataatcacggctgcccattcaaagccatagactcaattacaactgtaggtgctaaccagcaccccttttgtttgtttccaaattttatctttgcacggtcataatgagatgagttaaatctattataatcttagtagtgatgctgttcatctctggaccttgtgaactcaacttttgtttaagttttatctcctcttatttacagttgttccacactcaaatggttctatatcaatcaaactccatctatctgggttctccaatcatcctccagtgcctagaagttggcaagaatggagaccctaaacccctttacaaccctcggatcagctggaagcaggtagattgactcaatgtccatattctaaataattttagagtcttgagtctttctttgttttggtgtttggtttttcgagacagggtttctctgggtagccctggctgtcctggaactcactctgtagaccaggctggccttgaactcagaaatccacctgcctctgcctcctacgtgctgggattaaaggcatgcaccaccactacccggcgagtcttaagtcttgatgggagaatgttaggtagctaaacagacattagcggggttgaaggctattgaggaagaacctctctcacatagaactttccttcttcaaattttctgaaactgtcccaaggccccattgatgaatatgccactcttgaccagagaaagagagagagagagagagagagagcccctaggatgatgacatgcccatcatgccctttccctgactgtaagcaatacttgctttacaatgagagtactggagggtttgagaacaaaaagttgggtgggtaggaaagggggagtggatctaaatgaagtgtggagtagacggtgaatatgatcaaaatacattacaagaaaaaaaaactaataaagaaaaaaaagagggagggaagagtgttagagactcagaagtgaaagcaaagcggtttattatttgcatcagcctggaatgtcaggtgggctggcccagtgcatagagaaatgtatatactctaacccatgacctttcctccccttccttccttccttccttccttccttccttccttccttccttccttccttccttccttccttccttcctccctccctccctccctccctccctccctccctccctcccttccttccttccttccttccttcttcctacattccttccttccttcctttcatagtctggacaatcttaacatttcatctaggcattatctttccccacgtcacattaatttatttatctgtttgtttgtttatttattttcttaacaaaacgggttcatctctatgtattacctcttgtttatttggtccagcttatcaggtgcatagctgtgcaggcgagtttagctatgagtaatttaattctctacacttctaggtggggtgaagggtgtgtggtgaagcagactttgggggttaggaaattggtagcctagtatgcattagcaaggactaatgttttctgctcatttgtagctggacttaaagcttaatgctcctttgaaatgaaccatcttatagtattctaaaacctatctgacagaaacagaagtcaggaatgttagtcagggccatgctacttcacaaagttcttccaataactagttctcctacattcttgctatctccaccctcatagctgactcagcttataggccccaggctaacaggctcctttcatccccactgccagccaggatgagacagcaagcatgtgcattactgaagtgctggagaaccttacttttcctctaaaatgatagaagggaccctcattctgccatgtgggccatatcttttcacaaagccccaccacgttgccctgtccatcaatgacattaataatctcttaaagaaatagggggaaaggggaccagagttagcatgaaaggtaaaggtctgtgtgtccttcacagtacagattatcaggggaatgatctggaaaagagcagcaaccctagccaggaggcctccagtcactctcagaaaaacagtcaggtggggtctacagaagaaggagaaagaggggatgaaacagatgaccaggatatgtctgcaaaagagtggggggactgccattattttccagactccatgaagctaccaagccatctgaatagaagctgccctctttgaaacatctgcaccaaatcaaggacatttggaggtgacgctccagatgtttgacagctggcagccaactaccagcgtgatgatgatttcgaaagtattgagcaagagcaggtcaggatgcacatagtgcttgcaggccaggctacagccagcatgcttagggggagcccttcagccagcagcggagagctcctgcaaatgctatcttatgctgattctttctgccttgactcttcttatgttatgtttaccttcataaatcactgtagtcattattttaacaactttatcttgaaatattcatgtgaaaactttgttaattcatacctccatgaatttattctcttatggatttgagtgaatacttaacttctgtgttccaatacattctaactttaaattttgtgccttcatctttccatttgacaaactcattttagcattttatttgttttaactaataatgagaaattagacctgttgttttcacataaacttctggaacccttttccccttcagttcagtatttgtttcatttattataagttctgtctttgttttatccaaaaaaaaaaaaaaaaagcatttaggcctggcccgcaggcagtgatgcagtggtccctttttggagtcagtttcttttctgctaatcttgttatttagtcctcactccccagggcaccctactgccttctactgccccccaccagtgcctcccaccccccctactgcctcctactggccccccatcgcccccccactgtctcctactggcccctactgcctcctattgctcccccattccctcccccctatctgaggacagaaggccttgctagcaaactctctgctgacctaaactcccaacccctactaatcttcgcttttagttgctcatatcatttttcattattcctatcatttgcaaactgtcactctcctatattcagattgttttttgattacttatttatttttattttatgtatattgctgttttgagtgcatatgtctgtatgagggtgtcctatcaggacacagaagttacagacagttgtaagctgccatgtggatgaacctgggccctctggaagagcagccagttctctgaaccgctgagtcatctctccagactgttttcttttaccatgatgatttacatttttacatgttgtgatagaaaattattagtatgagacaaatacaatatagccatcttgcccacaccacccagattttcccaaggaatcacattgcccataaataaagcacagtacaagccaggcagtgatggtgtacacctttaatcccagcacttgggaggcagaggcaggtggatttctgagtttgaggccagccttgtctacagagggagttccaggacagccagggatacacagagaaactgtgtctcgaaaaaccaaaaaataaataataaataaataataaataaatacataaagcacagtacccaagccatattaacattgcatgttatcacatgcatagacttgtgtgatgaacaccataatggaaaggcagcatcaatacaatgacattcttgttgctattcctttatttatttatttatttatttatttttttaaagatttatttatttattatatgtaagtactgtcttcagacaccagaagagggagtcagatctcattacagatggttgtgagccaccatgtggttgctgggatttgaactctggaccttcggaagagcagtcgggtgctcttacccactgagccatctcgccagcccctgagccatctcgccagccccgctattcctttacacacagcttttctttgcaatttgtgatagatgaaaacagtgtattctaatattaggataaaaataatatgaaaggcccggagagatggccctacaggtaaaggcgtatggtacccttgaacacatataaaggtgaaaggagagaactgaccccagacacacagcacagcaatgcacacaaacactaataataacggtagtagtaataataataataataataataataataataataataataataaattaaacatcaaagaatgaaatctataacatttaaagaatattgtcatgaaaatgatggtacagtccacaaaatggggctttaaaaaagtctttgccaactgtacattcgacagaagattaacatcgacaggttctttataaagaaattaaacccttcaaaaccccacaaataattcagccagtaaatgaaactgaacacacacaagtggccaatatctgaaaatatgtccatcaccctaagccatcagggaaatgcaagtttgggagtacatttgagattgtggaaaggagataaagccaacaaggatgtagggaaagggaaacttttattttactggtacagtgactctggaagttggtatggagagtcttgaaacaattcaaagaagaattatcaagtcaggcatatgcgtgcaatcccagcacccaggaaacagaggtaggctgatttttgtgagtttgaggcatatatgtattcaaatgctgtaatgaaacccacttctttgtttgctaattaaaaaataataatttccaagcgacttcatgaatagggaggtagcaaaatgtatttataatattgttatatacgcaataatgtgaatattctgcttttgatactaaatcacagtttgcaaggctgtggtggtttgtgcttagaaggggaaggcaggatcatagaaattctgggagctcaaatttaaggccagccagggatactcaaaaccctgttcaaacaccaccaccagcaccaccactgctgccagcaccagcgccaccatcgacatcacagctgccgccgccaccattaacaccaccaccagaaaaaaagctaatgcatgctaattccatgaattattttattttacatgcaattgtgttaattccttaatacttggaagcaagttgtatgctattaaaaaataataataaactgaggagttgcctaagcaaaacaactcaaagtagaaatactgtataaagaagaacacattaatactctgtaagaaacatcaaagagtagaaaagacattccttgggtaccaaaaacaaagaaatcaaagctactatacggaagccaaggcaagaaatgtggccaaacaaacacaaaggggagtttaaggaggaagggctgcctgcgggaagccaagacatctatccaaaaagaaagtgattattcacagccacaatagcaccacaaaaaagggccttttcttatcactacctctgctgtgtactgaatttatcccagtccaagagatgaaaagatgctacctaccactacatcttgcctttccttagtatcctttttgttcactgacttttatctttttgcctaattacctatttttattagttaataataacaacaggaacaggagagaataattgagaatttcatgattttttaaataattttattcagactatacaattgaaaagtaagaattgcagtggtttttttttctttttctttttttttttttttggtctgttttgtttttagagacaaagttcctctgtttcgtcctggttgttgtggaactcactctttagactaggttggcctagaacttaattagtttaagaccataattacaaaggctttattgtttgtatgcaaagcaagttaggttccttctggatagtttgtggtatatattatcataaaagtttttattttaaacttatatatataaatatatctttaaggataatggtacctaagtattaaaaattcctataaccagtcatggtggagtaattcatcccagcactcagaaggcagagcaacttttcaatgtatagtctgaataaaattattaaaaaaaccatttgattctcaatttctcttgaaattttctcctgttcctggtccttttggcagataaggcatattttagacaaaacagtattattatgaagactagtcatagaacaaaggagttcagaaagacaaggttaaaaagtctatactgagcccgtgaggtggctcagtgagtcagggtgccggccatacaaacctaacagtcagatctgtatctctcacccaaaagctatgaggatgatgcgcaatgagatcggtatttccatgccacctaataacacagtagccatttctcagttgatgcttcaatgaaggaataatttaaattatcaagtttaattatgaattacatttctcttttgtcttcttttgcccctcctggggattgaacctaggacctccttcatgttggtaaaagcactctgccactgaatcacaaacattaacagtgtgtattacagtttgtgatccatgggaggagtgaggaaaatagcaacacagtggctttatggcaggagtgtagtgatagagcacttgcatagtgtgttccatcaacctttgccaggaaaactagtaaaattaaccggagattggaggaagctgattccaaccttgatgggtgatcttggggatgagccaagattttagtagaagaaataacctcagatgtagtgaaaatatcaaaaggtagaattgagaaaggagtctaaagctgttagttaattgttggtgttagagggatggctcagcagataagagcaccggctgtgcaagaagaggtcccaggttaggttctcagcacccacgtggcagctaacaactgcctggaactccagttccaggggatctgacacctttttccagcttctgaaagcataggcacacagatgcacacacacacactcagaaagagagaaacaaacaaataagcaaataaataaataaaaatgaatggatgaggagtttgctttcttatatgaaaaagaacgagtttcttgtgatggcttttaaatgttgtaaagatgctgtaaacactgcttccatccatcacaaagaattgaaaatattacattcacttggtagcacagtagcagtgcttgaaagcactaaatgcaattaaagttcaatcatagcactacggagaaatcaacagatgtagagagtcaacggatgcagcaagctatcttgttttatttcaacaaatttactcagctaccccatcattgagggggcagggatgtcaaaggaggcgccaagtcagaatgtccttcccaatggcacagtatgcatagtctaaggtaatgctttaggccagccacagaaagcaaagggtgttaatggtcctgtagtgagggggatgtgtactgcaagacggccccaagttgattgacattaccaaattgggttaaagggcgctttaaactttgtagtttgggctggtgcgggtgcttaaaaaaaaatcccaaatacattttgagataaagggacagctggaaaattctgcaggacaatgagcatagtgacttctgtggtgagtcactgctcagtggcttctaggccctgggtgcctgggaagctgctgagtgagtccttgcccacagctctctctgtttagggctttgctctctgaaaaggacacactcctcac

SEQ ID NO: 51 - DNA, 72151 bp, Mus musculus
  misc_feature (42950)..(43541): n is a, c, g, or t
  misc_feature (62092)..(62092): n is a, c, g, or t
tttttttaagatttatttattatatgtaagtacactgtagctgttttcagacacaccagaagagggcaccagatctcattgcggatggttgtgaaccaccatgtggttgctgggatttgaactcaggaccttcggaagagcagtcagtgttcttaactgctgagccatctttccagcccttgttttcttaaaatttatttgttttatgcatattggtgttctgtctgcatgtaagtctatgtgagggtgtcagatcccctggaactggaattacagacagttgtgagctgctacgtgggttctgggaattgaacccaggtcctttggaagaacagccagtgttcttgaccactgagcagtctctctagcccctttgctttcttttttttttttctttttctttcctttttgttttttaaagacagggtttctctgtgtagtactagctgtcctgaaactcgctttatagacctggctggccttgaattcatagatcctcctgcctctgcctcctgagtggtagtgtagattggtttcctatctggaatgagtagaagcttgttcatatctctccaggaatagtgcacacaacacaatctagtttttaaaatatatataaatcctggctgtttaaaatgcctgttttcaccagttgtgatggcacataccttcaatctctacactcaggaggcagaggcagggggatttccatgagttgaaggacagttttgtctacagtgggagttgcaggccagccagggatacagagtgaggccctgtcttggaaaataaaataaatgaataaatttaattaaaaaaatagatgcctaatttcctcatctgttgcctttattttgttaggctagacagtattcttgattattttggttttaggcatattatttttatcatatatctcatgttaagtgcagagaattaaaaagcagtcacactgggatcttaatggctagcagagtttgacattatccagaaacattaacattaaccttccttaatggctttctcaactagtcctctctctcccaaagtttaccttcctcacatctcagcctcatatatgagtcttttttttttttttttttttttcgagacagggtatctctgtatagccctggctgtcctggaactcactttgtagaccaggttgcctcgaactcagaaatctgcctgcctctgcctcctgagtgctgggattaaaggcgtgcaccaccattgcccggctatgagagtctttataacaatgatatattaatatttgccccacacatgcacaacatgtgatgctagacctataggaggaactatgaatggaagttactagaaactgcaccttccatagaaacttcttcaaggctgattaactgattagaatttcaaagattatggagaagttggaatactgttggtccatagcttaatttagttatcttaaactctatttagcctccttaaaaaagcttttctttagaaatcagattcattcattttattttatgtggtttttttgttgtttgtttgtttttgtttttttcttgagacagggtctctctgtgtagccctggctgtcctggaactcacttcgtagaccaggctggcctcgaactcagaaattcgcctgcctctgcctcccaagtgctgggattaaaggtgtgcgccaccacgcctggctattttatgtgttttgccttcatttatgtctgtgtaccatatgattgcttggtgcttgaggaggtcataagaaaacatcagatcccctggaactggctatgagccacctggtgggtgatgggaatggaaccgggctcctctgaaagtcagggctcttaaatactaagccagctcttcagcctgatattagcttccttaatagttatttcttacccatctcagttcctgatccattatcctgtgactatcagagaaaaaccatttggaatgtattaatttaacaaatcctcaatttccatgacccaaaacattaaataacatttgagacttatagctgagatttttccacttgcctgtaacctgttatctccataatgtgtttaaaaagtgtgttggtttgtgactttcttcttcctgagctgcaatcacttctacttggcttcagaataagctctgtcttaccctctttgaggtaagagtggtatttttgtgtcaacaattataacagcacaaatagacggacacaaatgggctaagggattctgatactacttcattcactacagatattgttattctaggtttgaactctgcccctttctaggcatcacttagttttcttacctagcacatcagggtattggggaaaaaaaatcagttaacctgtacaccagaattacctggccaaggtaggaaagcggggagggctaaaaacagatgcccgattactacatcatagagattctgtttggggataggtcctaaataccaaagtttattactttccccaactagatctcacaagttcaactgtatgggagtctatcagttggccctttggtgaaggcagttttaaagataaacaagtcattttcatgaagattgacaaaagaagctttggggacagattagagactaaaagaaatggtggaagtggctagggtatagcttagttggtagagtgcttgctcatttcagcccactcttacatttcataacctgggaaactaagcttacataaatcaactttgccaatactgactttgatagaatacaactgtagcaattccaactagagtggaggtaggaggatcagaattccagctatatagtgagttcaaggccagcctgggatctatgagacttgggaccagggtggaagacagccagagtccacaggcctaccctttggggactggggtaaacactactacagtgagcaagtatgtggtgaaaagatggcagagaaggagaagcagagcagtttgtgttctatgaagagaggtagaactatgaggaacagcctgatgtgagaggcttgcacagccaccatgatgatgtttgggactgtgctgccgccaaaggccatgtatgcttctgtggccctatagcagcaggcatcagtgtcaatgaccatggcccatgttaccactaaaggccacatgggagtgcacggtctcacacgccatcagaggaaatgttgctgtttgagggcagtacccagccgccgcctcgccccgccccaccccccttgcacgctgaggcacctgggagagctggccccgccccagtgtggggcagtgcaggagggctggccccgccccttgcctggccttaattgcgtgagcgggaaagctggcccctccccttgctcgctgaggaacctgggagagctggccccacccttgctcattgaggcactttggagaaggaggccccgccccttgccatggccatgagggctagtgggctgaccaactcagctaccactcaggcccagatccaaggctttaggttagcccaccccaacacataacctatctatgatctgctgaagtgcgtgcagggggtctgtctgcagaaccaaaactgcagagtctttgtgacacagggcaacagtaggatatcctagagaagtctctgtgagggtctggttttgatgatgtagcagaagtcagaggcctcgaaccagaccaatgactcattgcaataaacatttgcaagttaacatgtgtggagaagggttggagagatggctcagcggttaagagcactgactactcttccataggtcatgatttcaaatcccagcaaccacatggctcacaaccatctgtaatgagatctgatgccctcttcaggggtgtctgaagacagctacagtgtatttatatataaataaataaatcttaagaaaaaaaagatgtgtggacaaaagggtatagtgtgagacacactgtgacacactgcagattccacagcaaggtttttttttttttttaattttaaaaatatttttagggggctggagagatggctcagtggttaagagcacttgactgttcttatgaaggtcctgagttcaaatacacatggtgacttacaaccatctataatgggatctcacaccctctactggtgtgtctaaagacagctatagtgtacttagatataaataataaataaatctttaaaaatacttttagtttttttggggggaggggaggttgctagagtggagggttgatatgcagggatggtaagattagtgggattggagtgcaggatgtgaaattcacaaagaatcaaaaatggaaaaagcaggaagagggaggataaataacagggtatttttttttctttttactggttctccattttacttcctgttattcatcaagtggctcacaactttctttaccttcacaaaagctcccaatttgcaattcactttctatgtatcaccttctcccccacctccccctttgagatgagagtccaactcttgctgttctggaacgtgctgcgtataccaggctacccggaaactcacagagatttgagtttatgcctacttagtgctgggattaaagtcctgtatcatcatacccccttttaaaaaaagaaacatgtattctacttcgtatctttgtggtttagcaaccttgtataatgctagatctcaaaggcttgaaaatcaagagtagaccaggctagagataagcagcagtcagctcacctaatgatacaacatgcattttgtcatttctcatctcgggccttttgctgatcctttgcagtcctttcaagatccaggttctgtattaggaactgaaacatacccaagatctctttctactcattggtaagtcagctttgaatacacatgctatagtttcccaatttcttcttttccccgtgggggggggggtctcttgcttctatgtatttctttggctggaaaatgatagcaaatcgagtgttaccttactggatctcaatttcagtcgtgtcaatattagagcccaaaaagtctgaaacaagacagatttctttgcaaagacgttggacaagtggacacaggcaaagaagagcacagcagctaactgatcagttcaaggcccgttgataggtatttaaagtattagtggtagcaggaagaggggctctgaatcccctaactaaggaggtattgacagtggatagcagctgttggcagagggaaattcaactttaagagtgtggcccttggtagttgcagtgaacgggcaggcccacacccaggtaaatttggacagcacaaactggacttgtggtttgtctgtctgtctatctatctatctatctatctatctatctatctatctatctatctatctattaaaaagaggactcaatgttgagaaggaatgaagtggttagggattggtctgggaggagttgatagaggagtagggagtagtatgagcaaaaaacactatataaaattttcaaataattgatgaaagcatattaaaagattagtggtcatttactttatactaaaagattagtggtcctttaatttgtttttagcattggataagtgatttacctaagcttcagtctggctggagagatggcttagtgcttaagaacccttgccactcttccaaaggactggagttgtgctcccagtacccatgttgaacagctcacaactacctgaaactctagctctagagggtcgatgtcctcttctgacctctgtgggcattggactcttgcgaacatgttcatatgcacacacacaaacactcataaataaaaaataaatcttaaaaaaaattagtgggggctggtgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataaataaataaatctaaaaaaaaaaattagtggacatttagttttttttccccattggacaagttggtttacccaagccttagcaaccctggttctaaattttaccccagctcaaatgctctaagtactgtgctaagcacgtggctactttgtgactgtcagagctttggagtccagaaagtggggaggatagagagtggacagcttagagaatgaagtaagctttaagacaaagcagttaggaagctcattttccctctcaagaaggagttccttatcttcaagttagacatcagtaagcctactttactgaaaaagctcaagcttttggacagtgagaatttttgagagaaaccagaaagctgcggaaatgttaaaagccctataggtatgtaaaatgtgattgggctgaggtctaaggaactgaaaggcaaggggctgcgggcagtggtgacgcacgcctttaatcccagcacaggcaggcggatttctgagtttgaggccagcctggtctacagagtgagttccaggacagccagggctacacagagaaaccctgtcttgaaaaaaaaaaaaaacccataacaaaacaaaccaaaccaaaccaaccaaacaaacaaaaaacaaatgcatttcctcagtacgttgtgtacctacctcttaaaaattataaataaaatatcttggcagggtagcttttgtgaatacaaggactcttgtcacatgccatatctgggagccctgctcctgtttgatttgagaagtctaaatttaacctattcttttttttttttttttttttggtttttggagacggggtttctctgtgtagccctggctgtcctggcactcactttgtagaccaggctggcctcgaactcagaaatccgcctgcctctgcctccagagtgctgggattaaaggcgtgcgccaccacgcctggcttaacctattcttaatccaactgctgacatcatagcttgattaaaacctactatgctatcttaagtgctatgataatacagacaggaatttaaaacatgatttttttttcttctcatgataccataatattttagttgtggtggtaaaagaggagtgctttctcctttctgaataaaaagttgagatttgtggactgacaaatgtaccttttctggagacacttgaatagcatccccaacgtgtactataatttttaaaaaatctggataataggaaacacatttgcagaaatagcatatactgtacacaagtgctaactaggtaacaaacgaggggacaatgttactagatctttttttttaagatttatttattatatgtaagtacactgtagctgtcttcaggcactccagaagagggcatcagatttcgttacagatggttgtgagccaccatgtggttgctgggatttgaactcagaacctttgaaagagcagtcggtgctcttaatcgctgagccatttaacatggggaaccagcccaggagaaagcagtttgttgcagtcaacaaagctgaaaaaggagtggagatctgaagactgctttgacatcagccatggagatgcagagtttggagtttgcccagctggtttcctgccttgctttggggatcacagttaattaagttgaatgaatctcagaagagaccttgaactttggactttttaacattgttgcaactgctatagactatgaggactttgaaagttggactaaatacattttgcattatgctatgtttaaatatggccccatgttactagatatttctacttacaagggccacaccaattcatggacgcaagactgccagatcctcttagagaacattctactaaggacacaaatacttcatttttcaacctagttcctgagttcccagagcatcctctctatgttcatagagctctatctgcctgcacagatttgcacaccatgtgactaagatgcagggtatcatcaaggggaagcaagaagacctttctgattccattaatggtgggtgcttcaggttaacgcatgagctttgcatctagggcacttaaagaactggtaaagatgcacaatgttgccttacaatgttaaataatgtgagcttaaaaatggagacctgggaagaccattaaaaaatagtgaaactgttcacttgacagtgtagaagtggaaattcacactgcctaatacctcacagttagtaaacagaaaaacaaggcatttggatacaggataaattttgggttgaaagttttgtggatgggttatcctgtatccaaatgcaggtacaggggatggagaagagactgaggaaatgaccaatgaatatcagcccaacttgagacccatccctgacactattaatactctgttatgcttgcagacaggaagctagcatgattgtcctctgagaggctccacccagaagctgagtcaaatgaatgtagacactcacagctaaacagtggatggagcttggggactcttatggaagaataggaggaggaactgtgggtcccagaggggataggaactccattgatagaccaacagagtcaactaacctggacccaaaccatacacaggctggacctaggcctccttttcatatgtagcagatgtgcacctcagttgtcatgtgggtcctgaacaactggggcaggagctatcccaaaagctgttgcctgtctgtgggatatgttcttttagctgggctgccttgtcaggcctcagtgggagaggaagcacctagtgtcacagagacttgatatgcccagggaagtggaaggagatacccaggaggggccccaccctctcagaggagaaggggagagggagatgggggaagaattgtgggagggggttaccaggaagggggctgtgagtgggatgtaaagtgagtaaaaaaaatgtataacatgaataaaagagcttgctttaattaatttggctctgatgatctgagtcggtggcctttctcctcccacatttgggattaacagtaagattaaataaacccttaaatcaatcccagttttggtctgattccttctttcccggttttccctttttgcaacaggaatgctttgtgtcattgtgctttggcagtatgtaacttgtttttgatgttttaactgcttaggtagagctgtgtttttaggaggctttggactggacttttgagcaatactgaaacagttaagactttagggatttttttttttttttttttggttttttgagacagggtttctctgtatagccctggctgtcctgggactcactttgtagaccaggctggcctcgaactcagaaatttgcctgcctctgcctccggagtgttgggattttaaaggcgtgcgccaccaccgcccggcgaatttagggatttttacggactgaaagcatcttgctttattgttacccagcacccagactcataaaatggctgccactgaccaggtatagtggcatggtgcatgcctgcgatccaggcaagttgggaatgttaaggcagaacactgcctgtgagtttggggctaacctggtgggtttcaggctaccttgtgtgtgactgtggtctggccacctttaaaagaagtaacaacaaaacaaagagcagagaacacccaaaaccaaaaagtaaaaaataaaataaaataattccttaaaacaaccccctcccccaaaaaaccttaggctgttactttttctgtatttttaaaagaattgagaatggaaattggtaaaggaaaatgagtttacttataatttggacaaggcagggaaagaaagattcattgtctcttccttgtcatgcggaaattcagggttctcagtatggactcagtcttgttaacaaaagaatctaacaaaagaatcacaggtagacacggtggtgcatgccttgaatggagcacttgggagccagaggtaggtaggtgtatctccgaggccagcctggtctacatagggagtttcaggccatgcaaggatatatatatttattgtaagtcagtgttccctccacctcttccccccaaaaggacagaccaaaaaaaaaaaattcaaacaataacaaacaataaaactcccacagcctagcctcaagaaaaaaacagataggcatacagaggatgcaagctgtcaatctcagcagttgccaggaggagggagagaaaagagaaagaggaagccctgctttttgagttaggatccaaggtggcatgttcagtaataatgcaggttgacaagaatttgtaggatggtctccaggcccacctggattaattattattattatttaaaaaattattgacttcctgtgtatggatgtatgagtgcctgtgtaaatttatgtgcaccccagacccatagtgctcttggagaccagagagtactggatcccctggaccttgagttacaggaggtgggagccacttgatgtgggagctgggaactgaatatgagtcttctgcaggagcaataagccctcaaccactgaaccatccctccagccatgggctaactgttgagggtggagacgctagtatgctctttttctaatctttggagtgatcagaatgtcagtttccacctagagccagaggcagagctcagaatccattctttccaccgggaggaagtttagctttcacttaaaggaactctccacccgggcaagagaactttaagttgtaaattggacggggcaggcaatgggagtacaggtgaatagaggaccacgccagaaaggtccatccacaaggctactaaccctatctacctaacaacagcattaaacttggaagaggtgaacagaaagcagcagatacacatatggtaacctgagcatgaggtaagctgttagaatagtgggaaatctcttcttccaccagcatggggttactgggcaagtttgaattggtggggctccattattttagggctcctattttactgtgagatggacataaacccttggaagtcatccacaccaattttttctagacttttccaatacatttgtttctattgtgttctatgtgttttctctgttttcattttgttttttgagacagggtttctccatgtagccctggctgtcctggaactcactttgtagaccaggctggcctcaaactcagagatcctcctggttccacctcctgagtgctgggattaaaggtgtgctacactactgctcagcttttcaacttgctcttttcaaagaaccactgtcattgtcaacaacttccactgacagaactaggcttatttttatgtgctctgtgtatgtgtatttttgagagttcatgtgtgcctatggaggctggaaagctgagctctgaactgctgagccatccttctaacccttattttgctattttcgatgaattttgcaaaggcattttttaaaaaatctagtataactggattaatcacctgaatacaacttaagtagaagatgctgataaggagtaacttgctggtaagacgcaggacttgctaagcactttcatatttctacactctacgcttaaacatttatgtttagtaagatcattcaaaaacagctttctacttagccatatgtcaaacactgggtacaatgaaggttcccaaagccaataaatggcatgaattactacttatacaatcagacacaatactactcaatgggaggagaggcaatatgcaaagtgttgtcattaaaaggaagcttcaagtaatagtgatctctacaaagtgatttatcattgttatcagtagtttcagccctgattattagccccagctggcctggaacttgctatgtagaccatgctgactttgaatttactataatcttcctgcttcaggctctggagtgctgggattagaggtctgtgccactacacctggcttgttgagttatggtgttcgattgctaccaaagggggttgagaatacgtttgatgatcaccatcatagcaacgttttcataaggcctaaacttgtgtaaaaattaatataaattaactttattatacaacatgacaaattgtgatctggaagtgtaaaccaaataaactctcctttcctttttaatcccagctctcaggaggcagaggcaggcagatctcttagttagagaccagcctggtctacagagtgagttcaaggacagtcagggctacacagagaaaccttgtctcagaaaaaattacatttaggtatttatttgtgtgtgtgtgtgtgtgtgtgtgtgtgtgtgtgtgtgtgtgtgttatatgaggtcagaggacaacttgtagaagttagatttctccttctaacatgtgggtcctggggatcaaactcaggtcacctaggcaacaagacttttaccatctgagttactgtatctgcccctaagtaatgatattataatgatgaaaacctaaggaaactgagacggtgtgccccaaagccacacggttcaactcagtaccatgggtttgtactttattggaatttgcatcctgagaataaaattgtatctgacaagtgaacaacgacagaagcagcagtgggagtttcagaggcaggtagccttcttttggcacagctgtatataggttgagttcttccaggagagtcagtcctggactccagggggaagaggaattcattccacaggctacataacactacaagatgcatgaatgttcttggttcgacagacatagccactatgattctcttctgggaaagctgttccaacaggaatccttggccaaaatggagaagttgtttcatttttcaatccaatctttagaacaacgccagctctatctggatgtccttgcagtagaaattcacacttatatataattagtccaaggacagcaaactagcttgtagattatataatttcaaacatttgtaacttgttccaaagtcctggcattagaacaattttcaactatttgcttacaataaaaacagaaaagcaggaaaactatgccaagataaaagcaaatcaaagaagcaggagtaaaaggaccatttgagaacttattgccttgattaccatacaggctttacacatagaactactttcagatgctgagaaactgttacttagactaatgctagaacatgacaccagaacactgcaatcctgtacatttgcaatcctgtgtgtgtgtgtgcatggacacaccccactgaatcagttcagttctagagtccagagacaaaccaaaactgaaggcaaattataatctgaatttatagcttaatctagtcaattctcatttattttctctctctctctctctctctctctctctctcccccttgcccccaatcattcaggactaggacacaatgtgttgagaggccaaataattttagttcttcttaaaagtggctcctaacattttcattatatggatctctaaattccttccccattttcaagtatatattaaagtacacttaaggacagctttctcatttctattaattacaagcacacttccattcacagcttttaatcagtgtcagtaagcatgtcaatagacagaacaggaaagaacatgagcaaaatgcatggtgattccatgtgttgtttggctggtgtagaaggaatgtgataggtcagtgtgtggcctttagtgttatgtgaattaatgattcttgagaaaggctcaaggctactttccactgctatttttcatctactctaacctgagggccactagtttacacccacctgctttcctccctaaatcaagtattaatatagtacaatcactcatgtttaacaaatagggcattagcaacaaaaatgacttgggaaaaaaattgagtcagaacactctgtaggatgttactgagaaagaaaacataatgcagactgaaagtcacatctacgtagaaattatataatcatgctatccaatatttcttttagtcagcttctaagcacacagacacatgaaaaagaccctcaattcccctgtgaggtaggtccagaatattgtccccacttcagcaatgaggacatgaggtacagaggaattaagcagcagagctaggaatgaaaccagaagtgacttgggtttgaactttcatgccattttcctttccaccgaattttctaagtccgttcggatagatccttttggtgagcagggaacttggtgagacactgaaggagatgtgaaattgagcctgcaactcttcacacagtctaagcggataccaatgtcacacctgataccaactgcgtagtcagattccacatggcaaacagagatcccagcccctccttcctagggaaactacattcacttttatcagcacagagggaataaggtctaccaggcattgggttctttgagtgtgttttcactaacacacatcaactagcagccagccagcaaactgaactcaaactgtgtgcaaggcactgtgagtttccaccaagtgcagatccgagaataaccattttcacacactgcacagcaaagatcttctgtggcttctcagaaccacagaatggtaactaacctctcatttcctgtctagctcaaggttcaaccctctacttttacagaggaaaacactgacacataatttagaccacttgcctggggccacaatattagatagtttcttcattaagtctgactttgacaaaattcacagaaaatggaacatattctcaggttgccatcatcaaaataaaaaggctggctcagaatcaggtgagtggaaaagctggagcaagataagaattatacacatacatacatacatatatacacacacacacatatatatacatacacactcacacatggaaggatatacttatagatacccttctattatttttagctcacaaagtatatgaacaagtattaataaacttattctttaccacgaaaaatttcccaacagttcaccactcaagggaacctgaatgatttgatagttgtaaaatagacctttttttttttaaagaagcagacttaagtccaattataagtataattggacttaatttcaatgaattgaatacttccagtcaatttaggaaaaagtatttccactatgtgaagttagtccaatgaatcagatgagtgtaaattctgtatttgcttaggacatacagtaaactcaaataaaatattgtttggggtctttgtgttcaagtaatggtttatttttaagtggcagcttatctgtaagcaaaaatgaaggtgctaaggatttgtaaaggtctcaccacatttgaaaatacctaattgttgttaggcttacaaatggtattgagctctcctaaagttatcaaaggcaacaataattctcattaaaaatggcaatgctgggcacaaatacagtttaatttctgagatattaatgtttacaggtcatgttaatataaaaaatggggaattattattattattattattattattttggtttttcgagacagggtttctctgtgtagccctggctgtcctggaactcactgtgtagaccaggctggcctcaaactcagagatctgcctgcctttgcctcccaagtgctgggattaaaggcttgcgccaccactgcctggcttgggatatttaattcttaagtgagttttggtagggtcttcaatcaaagacagtccttccagaactgtgttaaattctatgcttattagcattaaaatcataccaatttttaagtgcctggtctattctgtgatattttgtcattaatatacaacattattagaagataagtaaatggatttaaataagagaaatataataacctagtgctatcatgcctacttgaaaagaagcatttctaatcattattaattcatttattctgcttccttctacataccacgttatctttgaaaaagacaaggcactttcccatctatttctaaagttacaataatctttttcctaaattaacatggggtaatgtgggaaacaagtagaggacatgtctgagacaagggcaagtgacatttgcccttatttttattaataatatagatgctactggccttttacataagctttaaattgaccaattggatcaatttattaaaccataatcttggatcaaatgagaagtaacaaaaactaacttcctttcctttcctttcctttcctttcctttcctttcctttcctttcctttcctttcctttcctttcctttccttttttcttgagacagcttgtagcccaggctggcttcaaattcacagcaattctcttgccttagccccataaatgctgggattcactaatttatggggtataaaccaccatgccaggcttttcagaataagaaaaaaaaaaaaagtcctttaagttgaaatctcaaagcctatagagatttagaagctttggcaaaatgttatttcaaaactttttttcctttggaaactaccatggtaataaaggagtattatatatcaacaaaattattctcttttttagtcaaaaataactttcacaaaatacttggctaacccaatagaaaaatacaagttacattctatcctgaggttaaaagaaaagaagtttggaggggaagggttagcatttgctgtgactaatttcaatgaaaaggaacttcttccccactcaaactaccagtcacataaaaaagaaaagtaacgagaaaactatcacctgtcaatcaatatactgaacaataaaataatacagttattagtgaggagttcaaattgatatgacatgtaatgataaatattttaaatgacaaatactattgtaacttgaatgatacttggtcactttcatatacaatctattcctgtcttaatatttgtttcatggaaacaattcattacacttcttgattttttttttctgaacaaaatgaagtgtgatttgtacatggcagaaaaaaattcctatgatgactatttggtcaaattctaaggctacagacgaaatgtaagattgctgaggattgacattcacaagtaatttttttaccagtgagaattaaaaattctatattatgatggaaatcaattttggtattaaaacaccacagtatgaagcataaatctgatgacattagctgaaacataagacatagatatgtttttccctgaccttagctataaaacaagacattgggtatgcattttcaaaggcttccttcttatctataaaaatacaccttcaattttgcagcaggcagacatatttgcaggcatacataatatattagaacttagagatctggggtggctgggtggctcaaaaagattttgtgcaaaccattagagccacatatcaaacaggatgtccttcctctttccaccaaggactaaggatttcagattaggcataactcttaaaagtgccttaaaaaggcttgaccttgttaagcttgttccgttcactgagatgagcttacttaaaagcagttaagaatagaaggacaaagagaatagaatgtatgtcagtcactgcaaattacaaacaatgcccatatacaggcattcacttgcagttgaattaatgtgatagaaaaacatttattatattatattataatttcaaattatagtagaatcaaagtagtaacatcactcaatttaattatggaaaaaaccagagaaatatgcatgtatcaatcaaaaaatgtggccaatttacaaacgaaaacaattttatctaaattttacttgtctttcctcaataatttataagtgtttaaaaaagatccccaatcagacggctgaaactgttttctcaactctgactagcctactatgtaggtagagcttctctgtgctctttctcaatgtaggatacaggaacttcagaagaggataagccatggctttcacggaggccttgatacctcacataagaggcaaaaatctcaagacactttgttttttttttaagacagggtttccctgtgtagccctggctgtctcagaattcatactgtagaccaggctgtcctggaactcatactgtagaccaggttggtcttgaactcaaagagatctgtggcctctctctgtcttctgagtgctgggattgattaacggtatgtgcccagctcttaagacatttaaagactgaaatcttgtgtaccttcaaagaagggaaaggaaatgagagctagtgaggctgtaagatgggggtggagtggaggagaaatggaaaacagtgaagtaaatggaaaagaaggttcttggtctcaggtgtgatgcctaagatctgaagtaatgatttcaattttaatccacttattaggaagggcactccgccccacacctgaaatttaacatactcagtttggctttgccacaaaacagcatgttaaaggtctctacattcaacaggatgcttacaaacatcattcatagtaaaatctatgtggaattgttggcaatacattgataataataatacattctgtaaaccatggcataccacattttacattatgcaaagagacaatatttacaagtctttaggagtttaaatattttatccactaacataagtgacaatttagcaaagtgcaggaggaaaccagtgctattaattgcattttctttaagagcagagtaaaaccatttctaaaagctaccaaaagcttatttgggtgtgtccagtaagggattacagagcattaaatagcctagaaaaatgatgcatatttagaaacagtgagtatgaaaatcataaggcagcatgctcagaacaaggtttttgttttgtttctttaaacaccagcactgatgtttttagtgttaacgataaatacgggtatatgtttgcatttatttaaaaattgagagtgcaaaacacaagcctcatttaataacaaaaaagatgtgcaaattttcttaaattaacacaaataaaagagtgagaagaatagtctactgttgtaaagaataaattgaacacagcgaaggagactgtctccattccaagatcatctacaaggcactaagggtaggaaatgacagataacacagaagagactgaagaaaactcctcagtcgggtcggaatatggggtattttggtaagaattctattagtattacctgtaaaataaagacagaaaagaatatattgacaagatatttttcatttaatgtacataacccacaaaatcttgttgagtaccacaggactgcattttcatcgtggattacagggagtgattgaaatgcaaaaaacagttattcaaagaattaggttatgaccaaacaggcctcttgtttccaaatcaaactggcagccaaccctacccactagaactaacagttgttattgcctgatttatgacagacatttgccaagaggcaaaccctattacagttttatatcccgtaccttttctttcagccaagaagaagaggttaaaactactttatatagattagaaaaaaatatttctgtttttgtgagacagggtctcaggtctcactatatagccctggctggcctggaacttgctatgtagatcaagctggccccacacttacccattcacctggcctctgtttctaagagctggatgaaaggtgcaagccacttctattattatgttcttctattattgttatgatgaaggcaggtctatgtacctcaggcaggccttgaccttgctatgaagtcaaagatgaccttgaacttctggattacaggcttagagtggtgctggggaccaaactgagggttctagatgctggacaagcacttttctgattgtactatgccctcagcccttggaatgtttaaatgataaacactggaagtttggaaggttcaggatgctgaacagatcatattgtttatatgtggttttatgctttgtgactaaggctacctattttctttcatatttgaaaagttttttgaggtggggtttcattatttagccctggctggcctgaaactcgcagggatgtgctcacccctgcttctcaagtgctgggataagaggtatgtaccaccgcacctagcaggatttagcctgtatcaaatctattttgatagattttactcattcaatagtttattcactccaagctaaatgccagccaaattaaaaaaaaaaaaaaaaaaaaagcaaaaagcagccagggatgtgagtccaaaactgagagtgaatccctacataagttttttgataagcttgcacctcagtggattttgctaggcagcagctgttcttactgccatatgttatatagtttgtgtctgaggtaacagaaatgaagggtatggaacattttcagctgagcacaggagctcagacttttcaaagatgtaaatgatctccaaactccggagatactttaggttggccacaaagcaaaagaaaatgaacggtggcctctgcaccccaactgacagaaatccgggctgagaagctaaaaggcacaattaacagacagcaagcacaaggcgtaaaaatccaaagaatgcaattaaaacagcttcatacttacatactccatcatattgctagtttcacatttccttttagtcagtttccagtgcagagcaagctaaaaaggtaagagttttggttaagaattcttctatctttggctaattatatttgaatatgtcactaaaagtacaatctaggctgcttgagataaaacagtacctcacaacccttatcaagaagacatactaatgggctggagagatggctcagtggttaagtacactgactgctcttctgaaggtcctgaattcaaatcccagcaaccacatggtggctcacagccatctttaatgggatccaatgtaatgaggtctgtctgactctgaagagagctattagatataataataaataaatcataaaaataaaaactaaaaaaaaaggaaaaaattcttttttttttttttttagatttatttattgattataggtaagtacactgtagctgtcttcagacactccagaagagggagtcagatctctttacggatggttgtgagccaccatgtggttgctgggatttgaactctggaccttcggaagagcagtcgggtgctcttacccactgagccatctcaccagcccggaaaaattctttttaaacaaagaaggcatactagtaactgaggaatagtccattagtcgattcctttgtggacttagtacttactttttcaatttgataatgcaaacatatgaacggagcacttacttgcctacatgtcttaccttgtggtataatctgttattttcccattctagtaacttctgaatcgatcttctggtctaagaaaaaggatcaagattctgtgataagaggagctgaagaacgttataagctacatgtgtctgtgtttttctgttttcttgtaaggtacaattaatttcttctctggtttttctattataaaccagagaaaaggcaatatatttgaaagaaattgtcaaaagcaaaataactctttgggtggttactatataggtagaaaaggagctctacctatccatccatctatccatcaatgaaactttaatttatgcttttccaaatgaaggacgcaaataaacggtatgtggctatgcactggactgctatgaaagttgagccacagtgctaacacacaacagcagcagttgtagacccagtacagttgttcataaacctttctcacaactactttttcaatacagatacagatacaggctgagttcctccaggcaaacccttttaagatgcaagtattttgtagggacttagaaaagtagagcttttaaaaccattctaagattaccaggaattttttattcttattagaaattttaataagtttctgattaaaaataaagaaaagccagatgtagcacacatctgtaaccccacctttagggaggtgaatccctgtgagttctgggccagtcaggagtcacagccacactgtgagatcctgcttcaatataaataaaaaggatggaagacaggaaggaaggactcaattgtaaaacaattaaaaagaaaaatcagtagaaaggtgaaagacctgtatttggttaggcttgtccacgctgtttcaatgcaacagagaaagaatatcctaaagtttgtatggaatcaccccccccacacacacacatatacaccctccacccctaccccaaccccatgacccaaagaaccaaaagaatcttgagaaagaatgaaggtagagatattacatatcctggtatgaaactatacttgaaaggataatcaaaacagtatgacactagtataaaaggcaggtatatggggctggaaagatggctcagcagttaagagcactgactactcttccagagaacctgggttcaatccacatggtggctcacaaccatctgtaatgggatctgatgccctcttctggtgtgtaggaatacaagccaacacagtgcccataatatataaaatactgaaagaaataaaatttgtatatgctaaagaaggatagatgtggtgtcctacacagtattaaaataagacagggcagaagactggggttcagtttttagtacctatattgggacgcttacaaccatttgtaattccttttttgggctccatgagtgctagcacacatgtacacacacacacacacacacacacacacacacacacacacacacacacacagaggcatgcacacaagcactcgtggaaaaataaaaacaaaacaaaagaacaaaagaaaatcaaacccctccacagatatatagacaaatagaacagaacggggagcataaaagtaaacccagccacatactcaactaaatttcaacaagatgagcaaacgtctacagtagggaaagaagggtaggttcttgaatggtgtcaggtagctggatatatgaagagtgaagttggccctagcttacatcatacaaaaattaactcagaatgaattaaaggtttaaatatcagcccacaacccataaaaattcttttaaaaatatcatctatctatctatctatctatctatctatctatctatctatctatctatctatctatctatctgatatgggattaatttccaaaacacataaagaaagcaacaaacgacaaaaacagcaaggaaccagtcctatagtggaggaggaaaaaggtctctaggcctttgccttaagctgctctaggcttttgtttcaggtcaagagggtaaggaaggaaccagccattttggaagtttggcgccttaattatgtagtcctggcccctctccctatctgtctgtctatcagggaatctgtctaattccgggtcctcaatacaatgatatatacatttgtaggacactctgaagccatctttttcatggtcagacagtgtttgctgagaccagcagaatcccggatgtgaggaagtggggggaagggtgagatatgcatttagtagggcaaggtagcacctttaatcccgccactccagcgggaggcagaggcaggaggatctatatagcaagttccaagacagccaagtctacacaatgagaacctatctcaaaataagtaataaagaaatgtgcataaatatctttccaccaggtaaggatggtatacacctttaatcccagaacctgaaggcagaggcaagaatttgaggccagcctggtctacatactgaattccaggacatccagggatacacagaaaaaccctgtttgaaaaaaaaacaaaacaacaaaacccaaaacattttaactttcctcagtgtttggttttgtttgttttgcttgtagtcacttcagttgttctgacacaaggtggtgctctaagtccaggtgtccactacagtctctgcagttctcaacttgtgacttgcgacccccaacactagatagcctgcatattagatatttacattgcaattcccaataatgccgaaattacagttctgaagtagcaacaaaagtaattttatggttggaggtcctatcatttaggaaggtggagaaccgctgatctagagctttataaagcaggagactggtaagggaggaaaatggcatgtttggcaacttgattaactaagggtgagtgcagccctccacggtagctaataaataatgaagccctactaaaaccatatcactcatcaaaccagatttgcatttatacacatgcactgaaaaggacagagggattttgccctctgtgatttttcaggtgctgtctaccatttttgttttgtttttttggtttttttttttttggggtggggggaagacagctgtttttctcactggtcggaaactcaccaagtgggctaggcagctccggtctttaatcccagcacgggagatgcagagggaggtggatctttgggagttcaaggccagcctggtatatagatcaagttccaggacaaggggctacttagtgaggcctttcatgtcttggggaagggagaagagaaaagattaatgaagctaaagctttactaacagagtaagaaaggagcagataaaagttagtaagtacttacaaaagtgatagaggggctagcagttttcatctcatggactagggaaggaatagtcttttttattagatattttcttcatttacatttcaaatgctatcccaaaagtcccctataccccccccccccccactgcccaacccacctactcctgcttcctggcccttgcattccctgtactggggcatataatctttgaaagaccaagggcctctcttcccactgatggccagctagaccatcctctgctacatatgcagctagagacacagctctgggggtactggttagttcacattgttgttccacctatagggttgcagacccctttagctccttgggtactttctctaactcctcttttttggatgtgagtacactgtagctgtacaaatagttgtgagccttcatgtggttgttggaaattgaatttttaggacctctgctcactcagttcctgctagctctggcctaaagatttatttattattatacataagtttactgtagctgatttcagatgcaccagaagagggtatcagatctcattatgggtgattatgagccaccatgtggttgctgggatttgaactcaggaccttcggaagagcagttagtgctcttacctgctaagccatttcgccagtccaggaaaggaatattcttaataactttttttttgcctgtagattgatcattagcatgagatggaataattatttgaaggagacaaaactcattcaaggagaagaagcaatctgaatgagtctatagcaagcaaattaaatcacgggctagagagaagcttagtggctaacattttctactctttttttttttttgtttttttgagacaaggtctcactatgcagccctatataggggaattatttccacagtacttaaatcaaataaagataatatacacaaatatacctgtaggacagtggtggtgcatgcctgtaatcccagcactcaggaggcagaggcaggtggatgtctatgagtttgatgccatcctggtccaagttagccaggactacacagagaaaccctgtttcaaataacaaaacctgtctcaaataacaaaacaaaacaacaacaaaaatcagccaaccaaccaactgggatttgaaaatcaatcagactagcaactttaaagaaaaactgtgcaatcataccaatatattcagggaaggcttttgatacaaagaaacacattcatgatgaaaaaccatgagtgaacccaaagtaggaaggaacttcttcaacttgataaataatatacaaaaagcatacagctaaatttatagctaagatcactcatgtgacagctgagggccatagccaatattcctattaaaaatcacagtgactggcatagctaatgtcatatgacacgaaagaaaagacagaaagaatggggcgtgtatttggttgttcaccgtcatgtaacagtttactatagagcaggtagcttatgaaaagcagattttactcagagttatgctggctagaacagtagtaaaagaaaaataactaaatctgagcgtagagggcaggagagatggctcagcggttaagagcactggctgctcttccagaggtcctgagttcaattcctagcaaccacatggtagctcacgaccatctgtaattggatctggtaccctcttctggtgtatctgaagacagaatactcaaacacatacaaataaataaatattttaaaaagaggggatagttaggcatggtggcacatgcttttaatcccagtatttggaaggcagagataggtaaatttctgtgagttacagaacagcctggtctacaaaatgagacaatatctcaaaaacaaaacaaaaacaaaagcccaaatagcaacccccaaaccaacagcaaaacaaacaacaaaaaactccaaacaaacagggtagagacatgagtagaaacctctacaaagaagatacacaaatggcaaataagcttgtgtgcttgtgtgcatgtgcacatgcacgcgcgtgcacagacacacacacacacacacacacacacacacaaatctgtccaatatcataagactttgtagaactggaaatcaaaccaacagtgaaatactgctgaacatgttttagaatgctcaagatctaaaatattggcaacaccaaatgctggggatgatgacctacacagaaatcctactcacttatgctaggaatgtggaatggtattgacaccgtagcagtttagcaatttccttcaaaacttcctgatcagccactgtgctttttaaagaggttgtgaaacatctggggaagaaggcatggcttgtgggggtgggtcactgaagtaatcctttgaaaggttttagccaggccacacttctgactggagttctctgctttctgattagccatgacttggatgagctacaaattcttgatgccacagacataatagtagcctgtctcgatggactatattcttgaaatcatgaaccaagctaaggcctttgttccctacgttgcatttgtcagatattctaccacagaacgtgaaaagcgaacaagacaatacttcactacaaaaatccgttctggatttgataaggagacatactgctttgctactactgtaataaaacaccatgatgaaggtaacttgaggagcttatttgggtttacagttccagaggattagactctgagatggcataaggaaggtgtggtagcaaggacaggatgctgagggctgacttgagggctaagcatgatacagagaactgggaatgaaagcttgaaggccacctcctgctgacatacttcctttagcaaagcctggtctctaaaacctgtccaaacagtgtcaccacctggggtccaagtattctaacatctggtcttatccggggatattaaaatttcaaaccacactaggaaaaaacaggaatgggagtgggcaatgaaagaatgccagattaaaaaaaaatagcaaagtagaaaaaaacaatcaaatctttccgtcttatgagctgaatctgttctctgaaaaaacaaatccacattgaaatcctgcccctcagtaccttggaaagtaaaagaatggaaggagatagttcagtacaaatgaggtcttacgggtgtactgtgccttgttgttggacaaagggtttcaggctatcatggcacttgctaggtagctgaggttggcatttatgtcctgatcttcctgcctctacctcctcactgctatgatcacaggcatgaggggtatgactggtatttttataggaagagaggattaaaaatcagacatgcagagagagagacttgtgaacatatagaaacaagactgtaaattaactgtccagaaagactcagaagagcaatcctattagagactatttattttgtcgtttttttagcaaaggatagggtcttactcactatgcactcctagtgtggcatttacttctgctgcatgtggatccagatgtagaactctcagctccttctcagcaccatgtctgcctgcacactaccatctttcctgccatgctgataatggacctgtaagccagccccaatgaaatgttttttttttttttttttttaagaggaagtcatggtgtctgttcacagcactagcaaccctaactaagacaggactcctagcttccagaactgtgaggaaatacattttagctggtcaagttacctaatctgtgctacattgttaccaaagcatcaggaaacgaatacattgttattagtcaccttaaaagtcaatagattaaactctcatttaaaatgtagatattttcagactggattaagaccatgacccatctattatattgtacatggcactaaattcagaactagggacacaaatagattgaaaacaaaaggacaagagctggcgaggtggctcagtggttaagagcacttgttactcttgcagaagacctgggttcagttcccagcacccacagggcagctcttaactgtctataactccagttccaggagatccaatgacttcttttaacccctgatagtaccagatatgcatgtggcatacatacaatcaggtaaaatactcatgaacataaaataaaataaacctaaaaaaattaaaaagaaaaggctacaaaaagatatttcatgacatattaagcaaaaagagactctggcagctatgctaattaatataggacacaatagacctataaaataaaaagaataaaaagaaaagaacatttaaatgaaaacgacagactacacacacacacacacaagttaatctgttcaggcagaataacaaaaatggcataccctgttttgtggtttctttttaaataatagccactgagtcagatgtggtggccctagcacttgggaggcagaggcaagtagatatctgtgagcttgaggctggcctggtctacatagcaagttccaggacagccagggctgttaacacaaagacatcctgactcaaaaaccaaaaccaaaaaaaaaaaaaaaaaaaaaaaaaccaaaaaaataaaaccccccaaaacaaaaaacctcaaccaaacaaaaaatgaaaccaaacaaacaaaaagctccagaaatttatgtggcttccaatttagtgttataagacttctgagtgtataaatgagtggagctttgattcttgtgccttcttttgggctgttttatttctgtttgtttgccttgtccaacttcgatgtgatagtttttgtttgttcttattgtattttattttgttatatatatttattatctcttagaagcctgttttttttctaatgagaaacagaaaaaaagtggatctggatatgaatggaggtggggaggagctgtgaaaaggagagggaggggaaccataatcaggatatattatatgagaaaagaacctattatccaggggctggtgagatggctcagtgggtaagagcacccgactgctcttccaaaggtctggagttcaaatcccagcaaccacatggtggctcacaaccatctgtaacaagatctgactccctcttctggagtgtctgaagacagctacagtatacttacatataataaataaataaatctttaaaaaaaaaaaaaagaacctattatccattttcaataaaaggaaaaaaaccccaagagttttatatatatacaaaaacaaggagagacagagatagtgatggaaaggcaaaggaggtagaggatgtgaagagaaaactctctctggccttttcatctaagggcaataatcccataaagacttcatctcttgtaaggttagaggactgcaacataatgaatttggtgaagatatataaacattcagtcactagcaatataagccgattgatgagaggataaatctatgaagaagacataatcattataaacatacatgcaatgatcaagaaactcaaaagtacgtttaaaaatgaactacactaaggtgaaaattaggtaattctatagtaacagagactttgatatactactttcagtaattgataaagcaactatgcagctcaatagagaaacccataaaggaagaaattaaacgccatactctgaagcaatgaacccacaagcaaacggagaatactgaatgaaagccgactattacatggtatatgtacagggcataaactaaagcagtccttggaaggaagcaaaactatgaatgacagtagtaagaaggctgctctcaaatcagtaaactgattcacaccttatggacctagtaaaaagaacaaattaaattaaaggcaaaaaagaaaaacaaataggagccgggcagtggtggtgcacgcctttaatcccagcacttgggaggcagaggcaggtggatttctgagttggaggccagcctggtctcagagtgagttccaggacagccagagaaaccctgtctcaaaaaaacaaaaaccaaaccaaaccaaaccaaaccaaaccaaaaaaacaaacctccgctggagaggtgactcagtgggtaagcgcactgactgctcttccagaggtcctgagttcaaatcccagcaaccacatggtgactcacaaccatctgtaatgagatctgatatcctcttctggtatatatgaagagaacaacagtatactcacatacatataataaataaatattaaaaatccacaacaacaagaccaaaaacaaacaaaaagataaaacaaaaaacccttatgaagtaaagcggttagccagtaaagctgaccagaaaataaatgggggaccgggagcatactcattagtctttaatattacttataaacacaaatatttcttaaatatggctatgaagagatagtggctaggctggatggtggttgctcatgctttgaatcccagcacttgggcaggagaggcagaagagtctctgagtttgaaaccagcctgaattacagagtgaattccaagataactagggttacacaaagaaacccttgaaaaggccagaaagccaaaaaagccaagaagaagaagaggaggaggaagaggaggaagcatgcacccaaagacctggattccattcccagtactgtataaactaggcatagcagcactatagtagtctatataatcctaccattcaggaaatagtggatgcaggactgaagttcaaggccatcttcacctacatagtgaattcaaggacagcctgggatatgaaacatggtctcaacaaacaaacacacatacgcatacacacacacacacacacacacacacacacacacacctcccaaaaggttcaaaggcaggctacatttaagttctaacattgtatggaatagtttcatgtcttcttagcacaagagcacacaatatattttgtgaaaggcacaaataaactgcttgaatacagctcacagatagaactttgtgtctttcacacaggcttattccttttctgtatgatatgatgtatccatagggctttcattttattctctttttaaaaaatacttaaattacgagctgaagagatggctcagtggttaagagcactggcaactcctccagaagacaagggttcaatttccagcacccacatggaagctcataactgtctgttactcccattccaggggatctgacaccttcaaccatcatgcaagcaaaatgaacataaaatgaaaataaatcattaaaaaaataaaaatgacaaataaaaattaaaaatacttaaaaaaaaaaacatagccaggcatggtggtgtacatgtttaatcccagcattcaggaggcagaagcaggcaggtatgagtttgaggcaaacctggtctacaaagtgaacacaggatagtcagggctacacagagataccctatcttgaaaagccacaaaaccaaaccaaaaccaacccaaatcaagcatgatggtgaactacaagttctgcttcataaaacacgggaatagtccatggcttctaaataactctctcaatttcacaagacccaaagttaaaaaggagaaaggtttacagtaatttcatatataagggtggtggcgtgaacaagcctgaaagctgaatatgaagccatagctgcttctatggttacatgcaagagccgtaagtcaaaactgactggacccacatgcctatgtagtggccacagttagctgtcattgaaatccagtcttctcagatctttaggttttatgagaaacaggctagatagcacaaatcttttgaacattacttaactaattagtgacgtgccaggggtaggatctggaacttcatacttgctgggcttcacaccactgatctgtggtttcaggactctaagtttttaaaaattatttattcattttgtgtatgtgagtacactgctgctgtcttcagacacagcagaagagggctttggatcccactacagatggctgtgagccttgaactcttccttcttagggctttcccctcaaatgctggcatcacagacatatgctatcatgcatggtttattcggtgccggagattgactttagggctttaggcatgcagtagagctttaaccccagcctgaactgtcatttcaaagatttttttgttttgttttgttttaaatatatgtatgtatgcatgtgtgggcacaaacatgtatgtgcatgcaagtggagatcggagtctacatgtgggagttggttctctcttctaccatatgggtctggagattgaactccagacttggcaggcttgtcaccaagtacctttcctagcggaaccaccctgctgtccctaggataaactctttagttaaaacaaagcaacaacagaaagaaggatatcagagaatcagcatcatctcagctttcactgactatcctattagaatactcagcacaaacacatgacttgaaagcacgtttctgtttcagtccctttggtgcagttattgagatggacaaagcataaataagtcacaggagagaaatatcttttttttctttttcttttttggttttttgagacagagtttctctgtatagccctggctgtcctggaactcactctgtagatcagggtggcctcgaattcagaaatccacttgcctctgcctcctgagtgctgggattaaaggcgtggagaaatatccttgataacattaaaacccaaaactttgtttcttagtgattgagactggctacactcaggatgggaaatccaaatcatgtaattcacattgaggttttaaaataacatcatggaagttagtgattataacttctaaaagatacaattaaaaaatgatgttgttatctcttttaacacttgtagaaagccagttgaaaatactatgcttgtattgacaagcaaattaaactatatttaaagcaaagctctgagctactggtggttattaaaggaatcagtagtctacttccaaaaagtcagagtggagcagcacctggtaacacacacctataatcccagttgcttaggagaccgaagcaaaaaacaaaacaaaaatcaaacaaacaaaaaacaaccatgagctcaaagccttcctgggctagagtctaagataagctcaggccaggtatgtagaagtgtgagggtatttttttccttaaaaatttatttatttctggggctggagagatggctcagcttccaaaggccctgagttcaaatcctagcaagcacatagtggctcacaaccatctgtaacaagatctgactccctcttctggagtgtctgaagacagctatagtgtacttagatatagtaaatctttttaaaaattgtatttcttgggctggagagatgggtcagtggttaagagcaccgactgctcttcttaaggtcctgagttcaaatcccagcaaccacatggtggctcacaaccatccgtaacgagatctgatgtccttttctggtgcatctgaagacagctacagtgtacttagatataataataaataaataaatcttttaaaaaattgtatttcttatgtatacagtgttctacctgcatgtatgcctgtgggccagaagagggcaccagaacccgttacagtcagtctcctgctgatggccagcaagcctcgtgacccttctgttttcacccaggcctagcttgtgacatgagtgctgggatttaagcgcacatgcttgtgcagagagggctgttacccatctctccagcccctttcatcacatttctttttcattactggaaactgaacatcactctatcactgatcccagcctgttaatcgtacttttcaaagatgtcctcccgaactggagaaaacagacctgaaataaaaatgaaattttaaagtagacaaaattgaggtagtgtcctaaattcatgacacaactagaaagaaatgttactatgacgtgttcaagggtaagagctttcttcacctttgaggattgctggtccttctggttggcttctgctgtagctcagaattattttaagtcatccttttgggttttcctttttttaaaaaagtaatccatatatatttgaatatataaattaaattgcatttattgaaaatggtgtaaactcatattaagtaataaactattggtaaaggctaaacaagtgactttctctttccataatttctttagcattaaaataaagacagcagtgttctgagagttaaataaatcatggaaacagttctaacacataataagtgttaataaatgtcagctctttttattttcatataataggctggttatacttactcttttgttgagacaaatcacgggccacaggctgcaccccagggtacagcagcagcagagacatccacacagcagccatttcacattgacagggagagcctttttcaagcatgagttcacacggccaatgctggtcttaaattcttctggagccacctaaaatagggggactctctttaaggatttgtgaacagctccccactacctctaatcctaaggaagacgccttatcccaaatatttcaatgtctcaatatagtctctccatacatctgtatcatatactcttggaagacttagcgagtaaagcaatacaatttcatggttcaagaacttcgcataatattcacaatgttctgaaatgaccaacaataaatggaaagcaacaggactgattggaatggaaacccatcaaacacttttgttagcaaacattcttgttaaggcaatggtgctcacagtcttcaggcaccctgactcaaagctgggctttggttagaagcgtaagataagactaaaacccaaacaactacccagaggaaatgcaattcaagcaggcattgataataatccccaattactttgaaataaactctcttaataccttttctttctggcaaatctgtaatataatagttaaaccggctattgtttgcattaacaaaaaagtggtatctggtttaaagctatctatcagtgttcagcccacataagactcataagtactccgagttttgaaggttgaaaaacccttcacacaaatttcatatttctagttaattacctctgttcctgaaatagttgcttgtgtttctctataaacaatgatagagcccactcaaaagcatgagtgtgacccatgtgagttaagatttgcaccaaaattcttcttgcaacttacataattcaaaggaacactaaaaatagtatgctttcagtaaaatcatatttctggattaacaagatgataccatgtcatttagaaaggagcagatggaaaactcatgtgaacaatttcagcatctggctataaaaataaaacttgtgatggtggtaaaaagataaattgctgtaaaatgaaagctacacaatgatgtgtgacatcacaaatctaaaagcttcactcttcacacatgtgtgtgttttacttttaacagggatgtcttagaattcacaaacataggtattaatggatgctataaagattcagttcagcactataactgtgaaaacattacgcagataagctttcctagaattgtggcacctgtaagttaattacttactccataaactggctattcttgctaacaatgaccagttttgaaactgtagaacttaaaatgtagtttatatagggaaaatgggctccactttccatctacactgctaacaatgtgatatactggcagtcattgggtaccaggaattccaattaagtaacatttctgggggttaatataaaaataaagtgagagtgtatgcaatggtgtcagcgtttggaggctgattatgggatggatccccggatatggcagtctctagatggtccatcatttcatctcagctccaaactttgtctctgtaactccttccatgggtatatgcctcagtacaggggaataccagagccaagaaggggagtgggtgggtaggggaggggggagggacttttgggatagcattggaaatgtaaatgcagaaaatacctaataaaaataataatgaaaaataaattgagagactcatgctataaaattgaaatgagaaaacattttaaagctaaatcagaagacttgcttctacttcatgccatgtctgggaaaaaccacagataatatcatttaatcttcttaaaaaagatttacttatttatgtagtgttctgcctgtatgtatgcctgtaggccagaagagggcaccagatctcactaaaaatgagtcgccgtatggttgctaggaattgaatttaggacctctggaagaacaactagtgctcttaactactgaaccattccccccccccctttttttttatcaagacagagtctgtgcagacttaactgtcctagaactctgtacaccagtcttgtccttgagtcaacagaaatctgcctgtctcagcattccaactgctgggattaaactgtgtatagtaccagctaaagtcaactcatttacttaattacaattcctcatatataaggtgaaatggcatagtttttgtttttaattaatttattgtattgtattaattaatatattttatgggtgagggttgtctgcatgtatccctgcaggccagaagagggcatcaggatcccattatatagatggccacgagccaccatgtggttgctgaggcttgaactcaagacctcttggagagcagccagtgctcttaaccattaagccatctttcctgccctgatataggcactggaaatcgaagttctaatttggaaggaatttcttatctagaatactttggaaaaaaagtgtaaatcacatctcagatgtagagatagaaaagtggttgcctgagttctctgatcagatgtgcatggagagcctcagttttcttacacatggattacaaataaaggataatctgcagcgtgttgagggaaacgtcaatgatcttcgggtcttgagtttctcagagctattctgtttccctgcttccttcctctccccttttttcagaaccagggctggaagccaggggctagcccatggtaagcaggtatcctaccggttattcctcctgcagtcctttgctgttcttttaaaaaaaacaaggtgccaagttactatgtaaagatttatgtgtcccaaacagaagcacttaacttccttttcattgcagggaatcaccaagtaacagttaaagatcgtttctatctagcaggactttctcagcacaagaccttctacctgagctaaggcctcgcagaatcccgggaggggccagacttctcaggcccctattctgtcctgactgcgtaacattggttcctcctatgaacaggctataatctctttccttttgctagaaaaaaaatctcgagaataaatgaggtaacaaccataaagctactttaggcactcagaaagtgcagctattgttcatatctcctggtaagactgcaggcaaaacaagagtattaattgcattctttaagcatttaagcactgttggcttaacaatgtgtatactttgaaaaaacaggaccatttacctcactgcctgggagtgcttatggaacagcatttcctactatcttatgctttattcctctcctctaaaaaaaaatctagtggatataactgtagtcactctatgatgcaggcaattctgtttttttttctttttaaagaacaaaattgatttcatattgtgacaataaattaaaaacaccatctctctctcagatgaatataattttatttcagaacggttattccgagaaggcttactcagattgtcaccttaagcttgcccctacaggccttttgtgttctcatggagtggcctgcaccagctagcgccatggaagcacatccaccccggtttggatgactggaactctggtgtcctcttcctcatccaaacctgacttccagctctatggtcagctaccactttgcagtacgaggagatgatctacagtgttgccttttttgagcttagcttatttagaaagtatctgttacacatatgtacttatttatctatctgtgtatgtgactacatcgtatgccctgcaggagtcagccactgtatggctctcaggacccagctcaggctgtctggcttgttggcaagaaccttttacctactgagccatcgtgccagccttgaaaggactttttaaaaaagtttgtgatcatgactggaacttttatttaaaagcagcatgaaagtacagatgagaaaattagaagaaagacatagaaacaaatctatccaaaagaacaaaaccgcgtataagggttctttaaaaaaaaagtttctttctagcagggaagaacagtgtagtagaaggctgagggaagggaaagctggcttgcagtctgaagcatgaatgaaagcaattataatagcacagtatatcctatatgtggttgattacatggttcagaaaatgaaaacaccaacacacctcaaatttgacacctttccgttttcaacactccgtgttttaacagatactctcttactactgacggactaaaactcaaaggttcaagttactacaaatgagaaatcaaattttgagtcataagagaagtatattgagaagaaaaactttcaccagaatcttaaacaagaaactacagtctgcactgactttaaaaagatgccaggactgggtttgggaaataaaaaccgtatttgagtaacagtataagtcataagacagacagggaacgagaatcaactaactcaactttaaacgtgtttggttaactatagattcgcggttattccaattggactcattcgcttctatacaactatttctagtattattggctaataatagtattggttaggagcctctgactttctagctggacagtaggttgtaaagaaacaaatttcattccttttgactctctcagaaataaaaaagaaaacaacatcaggaaggtgggggaaaggtcataatattttataacaggatgcaggagactctgcacagacaaaaactaaagcaaagcccagcaggactgatgtgcctccctcattgtgaggaacacaagcctatcaatcgtcatattggatcacaatgggggggtgtcagtttttatggctccccattgctaacactacacactgcttgccccataatgctctttgctgctttcaagctgagcaccagacactttcatttcctttggaaaacttaatgtgggtctttcactttctggtcaccagaatcttcctgtgcgtggataaacacactcatctacacgatttgtcctatcatgacagaactcactggtctgtactcacaagaattaacacaaaagaagcaaaaatggttaatagtgagttgtggagtttctgaaagggccttttaggttttcctaattcactgcatttttgtttacctcaaactggctacttagactacctcactcatgccaaaagactgatttttttttttaaataaagggtaactcttttctgttaggtattagaattatccattttacgacagtttacacaatgagtcttaagttggtaattaagaccttttaatttaattttttcatatttatggaaggcctccccttactacagaaatggtttaataatccacactaatctatactaatgaaacagtacctactgaagaaaacagattctcattaaggaaatcaaacttgaatttaggttataaacatgtaacttgaaaaatcagaccttcaggaaatagaaataaagcccagcggtagggtacatgcttagtgtgagcacggcactgggcttgatccccagcaacaaaacagacaccggatgctcagaatcggttttagtgcttgtctcattgttgaccacattttaagaaaatattgcactatcattctacattacctaatacatgagaaaatgcatatagtacaaactacacatacctgaatgtatatgaactataaaactaaccacctagccaggcgtagtggtgcacgtctttaatcccagcactggggaggcagaggcaggcggattcctgagttcaaggccagcctggtctacaaagtgagttccaggacagccagggctacacagagaaaccctgtctcgaaaccctccacccacccaaaacaaacaaacaaacaaacaaaaaacaactaatcaccagaagagaatacatgttttagccaggcatggtgactcatgcttgtaatcagaacaattagagagctgaggcaggaggactgccaaaagtttgagaccagcttgcattacaaaatgagttcgaggccagcttagagtacataacaaaactctgtttccaaaaaagaaaggagggcagatttaaatggaggaagaggaggagggagggatattgtcaagaacagcttccatccagatcatctaggtagtatgaatggttatcaaaagcagcttaccattcttacaactccaatttaaaaacatcctagtatcttttgtgtcaattgaaatttttagttgcagaaaaattggaaaggaatgaagaggtgtgaaaaaatattcaaaagattacttcagcacaaaaaaatggctaattaaaaagtggctaacgtgtatgcctgggagctatatttgctgacagtttagcagatattcattttctaaagctataattttaaatatgtaagaacaattaagtaagtattcaagctgcatataattccccagtcaaaacatgcagtagcattaatggaaataaattctctattggagattttttttttgttattgttgttgtttttgcttttttgagacagggtttctctgtgtatccctggctgtcctggaactcactctgtacaccaggctggccttgaactcagaaatccacctgcctctgcctcccaagtgctgggattaaaggcatgtgccaccacggcctggctgtttgtttatattttgagacaagttctaactatgtaacccagactaagtctggaacccatgatccttttgaatgctagtgctgggtttacagacctatgtcattgcaatagctcaacgtgatattttaatatacatatgcacgcctagtgaaataattactatagtcaagcaagttaacatatctccttacgtagttatttatcatttcttttagagaacctgaaatctgttcatttggtgaattttcagcatataatacaatattatttataaccatcacacagtacattaacctagacttatgtttgagtcctgggaagtctgaaatttgagcatgaatgcttctctatacaactgattatcgggaaacccagaaatagaaaggtagttacttattggtgtgaatccaattttagaaactcaagctaaaaggaagaaaaacatgtaaccaaaaatatgatgctttttatttgtaataaatgatgcataccatataacacttttaaaaaataatagtgactcagttaaaaagatagctttggcaatgaaagattggaaattatagatctaaatgaaaacaattacagctacctgcgctgggcaaaaaaggcaacactggaaaagctgagcaggtaaataaacaatggctgacattaaggaagaacagacgaaatagctggccagaggctggtagtcatggaaacaccatttagtcactgcacacagcttccaagcagggaggccgcctgttatttggcttcattaccagtgagtcaaagcatttgtcataacattgaataaaccataacacagtgcattagaattggaaaattcaaagcaagcccacttaccttccctgtcagaactgacggaaattcggtatcaaacttgttgctcaatccaaaccttaaaaacaaagacagaacaatatctattctattcagcatatttaaccctttctcacagtaagttataaaacccatgaggttttcttttggtcttcagactcagacaattgtgtcctgaatattcacaactttatgatgtatgtgccagttaaaaccaaacaatggattaaaaatgcatacgcaagtcctaaaaataacattacatttttaaaaatccattaaatccaacagatatgttctgaataaaactttacaggcagatatctgagttcaaggccagcctggtctacagagtgagttcctggatggccagcgtgacacagagaaaccctgtcttgaaagactaaaaaccaaaaccaaacaaacaaaaaagctgggcgtggtggtgcactaggtgtttattcccagcacttgggaggcagaggcaggtggatctctttgagttcgacgccagcctggtctacagagggagttctaggacagccagggttgcagagaaaccctgtctcgaacaacaaaccaacaaaaaccaaaactaaacaaaaactacagaaagtaaaactatacttcctttttcttttcttctttttctttgcttttttttgtttttgttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggctacacagagaaaccctgtctcgtacttgtaagaaacaaaaccaaaaccaaacaaacaaacaaacaaacctgattttatgagaaacatatagacatctgtgtctgtgggagattggctctgagccagacattggatatcaaaattcctggatagtcaagtcccttatgttattttttattggaaattttatatttatttgattttattttatgtatattttgcctgcatgtatgatgtgtgccatgtgtatccctaatgaccttggaggtcagagaagggcatcagacctcctagagctagagttagtgatggtcatgagcattcacttgagtcccgggagctgaaggtgaacggcattctgaatcactactttctgaaatctaggtaggaaactctatagtactaggggaaagtcctctgtaagggcaacaagtgctcttaaccgctgagccatctctgcagcccccagttccttatattaaaatggcatagtgtttgcatctaacccatatacatccttctgtattctagattatcctagtaatagctaaaacagctgctatgcaaatcattgctatgctgtgttgtttatagaataatgctaagagaaagtctatccctgatcaatgtagatggtgatttgtttcagatatttttgatctgcaaatggttggatttgtgcaaaacctgttagtgtgataccataacatataaagaagatggcagagtagcacatgtctataatcccaggatgaggcaagagatagtgagttcaaggccaacctgggctacatagtgagttcaaggtcgacctggacaatatattaagaattcatcttaaaaataaaacaacagggggttggagagatggttcagtggttaagagcactgactgttcttccaaaggtcctgagttcaaatcccatcaaccacgtggtggctcacacccatccgtaatgagatctgatgctcccttctggtgtgtctgaagacagctacagtgtacttacataaaataaataaataaatcttaaaaaaaatcaacaaagcatactgaaaagcaaacctgacccattactctcataattttggctaacaaggaatagctatcctcttctcacttaccagggatttctttttctttttcttttttgttaacattgaggacataaaaagggtgcttacttcaaatagccttaattctgaggctttcacttagtagctacaaatataatattaaaatagctgctggtgaatgaataagttttctctgtttcataagcgaactatgaagttaagaactacggctacacagaaattgcacaaatgcatctattcattactctaagccaagatgtggcagtcttcagcattagacaaagaggcacttgggaactattcataaagtcattttattgatgttattaaatatagagtctattatgtgtttgaagttgaccaagctggtggttgtcaaagattgaattctctttaagtgttttcaatgccttttaatttcttgaaacaattctttggatgataggaaatggaggcaaagaaggatgcatcctaccctgcctctctatagccctggctttccatccttgtgaagacgactattttcaatcatttaaaccttgcataaatgaatgttcatgtgctcaggttaagagtcaatacatataaagtcctgtaacaagagccacaattttgctagaaaactatatacttcataagactgattctaaactacatgtagtgtactctactgtacttaggaaaaggaaaattataccctataatacagaggtttttttcagttttgttttgtttttagattctacttagatttccttaatctttctcatcagactacaaaatggcttaaagccttgtaaaatagttacctgattgttttcagtgttggggactgagccggggccttgctcatactaaccaaggcctctctctgagtccataaagttatactatcagtatatcactgtagtctttcaatgacaggtaacaaaatggtaggccattctctaatccgagaagtatctctaaatttgtttagaaacctgctgtttgtaaatttaaccatctgttttggttctatatctaatgagactccctaaaaaacagtaattcagcaattatctcaactaaattacacgtactctagcaagggcagacttatgcacattttaagtaataagtatgatcatattttaaaacacaaggggaaaaatatctgatcagatgtatgttttctgtattttaatacaccatgccccgatatttatcctaaaaaagaaaagtataagtcacataaacaacatttttgaaacatttcatacttgcaagtgacattcatcattttgtttctttagtatcaaacctgtggaagttaatttagtaattttttttagacagggtctcactatatagaccaggctgggctctaacagctataaacatctgcctttgcctcctgtgctatgaccaaagggacgccccaccacatcccagtttcactttagactatcaatatgtcactgtaatctttcaatgataggtaacaaaatggtaggccattctctaatccgagaagtgtctctaaatttgtttagaaaggtactgtttgtaaatttaaccatctgttttagagagtgtcattaatttcatgttaaaattcatattttgttaaaataactagaaagccaaaaacatgaagatgatacaagtaaactggagttctctgacccacaggaaaacttaacaaagctttatagaggagagggatggtgatgtgaggatccctcatcactaggattctgatagtatcacagctatgtgaagtcctcttcctagcatgattcaacaaactagcatttgttgagggcctgtaataaatctgacaaacagacatagactatcactaaaatgaactaatagtcattgaatgtacttaaacggggactatgataggcactgaagattcatagggaataaaagattgttcttgctgttgtagcttacaatttagtgatggcaaagaagactgacagaaaatggtgacatttggataattaaggtgaggggaggtgtggattggcatttcaaatggaggcactagcttgaacagacataagataagaaatagcaggctgggttggtgacatggctcagcggttaagagcactgactgctcttccagaagtcctgagttcaattcccagcaaccacatggtggctcacaaccatctgtaatggggtttgatgtcctcttctggtgtgtcggaagacagctacggtgtactcataataaataaataaatcttcaaaaaaggatatagcaggttatgataagtagcatccaagcaacaaaggaaatagaaaaagatgacagagacaggttagatccagttttggatgccatgttccagagcttggactctatcctgacaaggaaggagaaactagactaagcttaatcaggacagcagttcatttagctctgtacttttggtattttaatcaagtaacaggctgaaggacagatgttagcgtgacaaggatagaggtaagacaactagttagggtagaaaaagaggcctgaatcggagaagtggcactggagaagaatataagcaaatctaagtcctatatcaatcattttttgatgcttcactttgggaaacatgagaagaaaagggaggtaacaagagatacacactcaactgaaacggagaataaagaacaaaaaggcacatgagagtgaagtagtccaggtaaaagcctcagtagtgtctggtacagagatacacatttggaaacactggattactagatcacaagaagcaagaagagaccatttaagatgtgtagacagtaaaagtagaggactaagcacaaaatcctgaagatcactggtatttaagaagcaagaaaggaagaagactgtgaatgaaaaatatacaccgggcaagcactctattataaaactatacatactaccaatgtctgatcatagtgatctcgattgaggccagattcttcacagttaaggtggcagaacccagccgagaggaagtatctatggcatatgtatgtactttaaagaaatttggtgaagagagattagagggcaggtaaaagggatgtgggtatcagaaggtttttgtcatagaaggattgaataaaattacaggacaatctagactagattctaaggagaatcaaagtaaagcactattggagccaggggctaacacggaacaaagaccttgggtggaggctagaagagaagggtatgaaaagcagaagagatgagttttaggtaaggaactccttgaattgcaatgttgggaaaactcagatctaataaagagccaatgcagatttgtagctgtacaggacacgattaaatggaattttaagaaaattagtttggcacaagcatacacaatgaagcggggagaggcagcaggctgtgcctataattcaagaaggggatggcaactcaagcaagagtattgccaaataggaatagagaaaatgaaaaatcttaacaaatttccaaatatatgatgatacaattctgggaaaactggatatagggcaattcaaggagaagaatcaaaatgactcaaagatttcagatattaccctgggagagtagaattttggtgttaccactataaatgtggcaactagaaatacaacccatttggggggaaaaatgttagccgggtgtggtggcgcacacctttgatcccagcactcgggaggcagaggcaggtggatttctgagtttgaggccagcctggtctacaaagtgagttccagaacagccagggctatacagagaaaccctgtctcaaaaacaaaacaaaacaaaacaaaacaaaacaaaacaaaatgttgagtgtaagatacactgagttacaatcaggttaaacatactatcttaaatatttatctcctagtcatggtaaaaagctacaaaatacttccgtcttttttaaaaatccagttgatggcaacacctcaatttttaaactttgaatagaagcaaatcttctatagatgaagactgaacagaggatagaaaaaggccagtatacaggagaagaagaaatagttcactcacattggtacagggccagggttgtagctcagagatacagcatttgcctggatgcacaatgctgtagtttgagtttcatcaccacaaaaccaaagaaaaccaatataacatatagtttagggtaatcaacacatgcctatgccagaaaaaaaatgaaacaaaaattggtattttagatgtattagtttaagattatttgttaaggattttgcttcatttgacagatgggatgttctgttattatagttcatgtttctgataccaaacaaacattttactaacaacagggtctcactctgtagcccatgccggcctggaactcatgtgttccagtttggccttgaactcatgacactctccctgttttaatctaccaaatgatggtatcacaggcttcaccatgtctggcttctaaacatttaatcttcttcttaaaaatgttagatatttagcattaaatgttcttcctaaatgagaaaatgtgtacaataaagctaaacaattttcatgtttagtaatttaagactggcttacacttttcagagttttcttcaaataattaacactaagatgctattagtgccattcctttacacctaactccagaattttaaaactgtgtgtgtgtgtgtgtgtgtgtgtgtgtgtgtgtggtgatagcagaaaattatacctataagaggctagccacagcaaacctcagagctctgttttaaatgagaacaaggaaattggttgtgtggaaaatagaatggagccacaaagaagttttagagaacttaaattatgcttccttgctatgtaatcattgcttgaattgtagaaaataatggggggagttggaagataaaattatgggtcaggatagaaaataccttttctttgtctagtcatggaaaattatctgcataaaaagtctggaaaacgagacagcaagtgtggtgggcatgatagtattttagaatttcatggaatgaaaaacaaaacaaaacaaaacaaaaaagaagcctggataccagaatcataattagtttgaataatggtctccctagtgacaaaagaaatggaaggaaaatggtgcaggaagttggcacctgaacattacaggttatctgcaaaaatcttggactaagaaaaaaaactgtcttcaaattacctaataaaaaataaggcccaaaagtcacctccaaagccttccacaattgacaaacatttggtaatacatacattcaatgatttaaaaggtgtattacagtcaaaatagttaacatgttaaaaattaagagatagcgtacacactggatgatttcgtactagcactcaattgagtcaaagggactatgtgagccatgataaaaattaaagagagtgtgacttgataggaaggcgcaaatatagtttgaaaatgcagtaaaagacaccacagtcaagagcatgaacacgacaccatattcaaactctcaagtatgtgcaatccaagcaataaaaatgaggaagcactcttcaaagcccagtgatcaatttttttcttactgtgcaacaaagatgataagaagtccttgcacactttatttccttaaatatgacataggattcaatgtaaaagaagtcatctgggttgagttttaaagaaattaaactcaattcattaagggctaatttctatatacttaatatacttaatatttgtatatttaatgtctggacatacacgattccctgtagacatcttaaattatttcagagccaaagggggttagaaaccacgcactcagaacccttcattttggagatgaggaacccaaggcctggaagtaagaatcaactgaccaaggtcacagtgccagtaagaagggaaactgagatttagcaaccaagatctctcactctgtatccattgctctttctactttgcataggttcctattaacctgaaactctaaggatatgatattaaaggaacgtcagagtagtgcgttcaacagagaaaggatgacgatattcattcattaggtaggaagaatggatggacaaatatgtgggtggatgaatacttatattattcacaaaatgcatcacatttttgttttgttttgtttttgaagaacccaaacctagatcatgtcacctgccacagcagtcgccgttttccactagccatcaatcttggcagcagagaagtctagtacatcctgcagtttagagactattcacttgccagcgcacgaacgagcagatcgcccctacttcagtctctctggctccctaccctgcaactccatgtcctatgctcactctttcctcagggtcgatgcagcgttatctcccacccccttcttttacacgatacctattcaacctgcggttttgccattttgaccaggtgccctttgctaagagtacgctttagtcagccctccccccactccgcaggcccctcaatgcccttctcattcggtttgtcgtcaaatctcagcctctgcaagcccccgaccccaatcgcttacacagtgatgtggccggcgccgcgcaccaacacagggtctggggcatatctccgcagatgctcctcgctcactacccgaggcgggggcggcacctcctcctcctcttcttcctcgtcctcctcctcttcatcctcctcttcttcctcctcctcatcttcctcgtcctcatcgggcccagataccgacgacgacgacgacgacgacggagacgacgatggagacgacgacgatgttgctgcctcttcttcttcctccaattccgagatggtgtcgaactccgccatgttgggcagcaggatgctcatcacgtgaccgcacgatagccgccactctcccggagaagagtttgaacctgcggagctgctgggagaggagggggaacagactgaagagaaagaggagggggcggggaaagcgcttgaggagacgcgcctgcgtgttgggtagatggcgcgggggttggaggcgggggcatgagggaccagggagtaaattcggtgtacgcttgcgcgcctccaaggggagggggccggtagaggtgaactccagggaattctcgaggtccggtctgcgggtgctgatcttcatactgcgtttcggacgtcagtctcttgtacacaggggacgttctcgttttagtgtctgttaattaatgcgggatatatttgcctttatgcagacagttgaggtaaagcaaattctataaaagagagtttaggacattgcccaaaatatctcaaggtacgcatatgtcattcccttacgcagagattgttcaattctgagaaaagggtaaacatttttcaaaggaggaaactttctattaatttcttacgttgaatggtactttgcggacttgctaagcatcatagactgtgctaagtgctctgtgtacttatctcatttaatctccccacaaccctatgaggggtgtaccacattgagtctcatatcacacaagggcaatctatatacaaagagaataaataatttgtccaaagacatggaactaataaatgacaatgagcttttaaatccagagtctcgtctgactcccaaagctctgttcttttagccaaacagccatggtgcctaaagttgattggaaagaatgggcgaagtggtgcattttggttggttcttataaataaggatacacaggtttgcaatgggtgttctgaagccggcatagtggcacatacctctaagcccagcatttgggaggcagaagcaggagaatcttttgagcctagcttacagagctcattctaggacagctagggttacaaagagaaaaagagaaacccttctgggaagggagggagggagggagagagggagggagaaagagagagagagagagagagagagagagagaagggagagagagagagagagagagagagactggggttggagaagaggagctgtagagtgtgcagcagagggtatgccagtttagagacacattaattaacgtcacccattctatagattccaagctgtattctttcaaataccatagctcatgtaattcaaacactcttgtgaggtaggcatctttatatgtcttttatagatgaagaactgatgggctggagagatggctcatcagaagcactggcttttccagaggggcctggttcaattcccagcacccacatgcctgctcacaagtgtctgtaactccagtttctccagggatctgacacccttacataggcatacctgtaggcaaaacactgatgtacatgaagttaaaaaaatcattaaaaaagaggaagagttgaatatcagaaaatttaaacaattcattcaggtcggtagtgacttgctctcttttttttcccattcaaacattctacctcatctttacattgctaaaatacatagattacctattttgagttactaggtaatgcaccaactggttcatatctgtcagtggcaccgaattttgcaattaagactataaagttgtgcagctcctctgtaatagaataaatattgaggtcctctatactaataccagcttttcttctccttcagatgtagtagagcatccattctgacagaactgggggtttagaatgagcctggtatcagcagaatagtggtaataagcaaaatatttgggcatatgaggaggggagtaatctgttataagagagattgttcaaaatatcaaggaattggcgttattaatattaaatgtttccactatattcaatagcttggctattttggaattgaaaagtaagctgtaacattttctataaggaataaatgtagcattttgttgcataaagagcttttctttagctagagattaggataaaagaaagaatcttaaaatattccataataattgttggctttcctggtgctttgaaacatatatcaacagcaagattgaatgaccttagacccaaggaggaaaatatttcccaaatatcttatgtataaagaaagagtttagtatatcaatatttagagggaatagtagtatttggctaattactgccttttttttttactgcttaattactagcttctgtttttatcactcaaaattagtctaggaaggaatttttgacagaaagggaaaggagtaagatatggattttgtgatgaatgcaaaaagtcattggaactattgtaaaagtaggagatagtggctaagggagaccgaaaggaagacggaaaagaagggtagggcaaatgctactatatgctgcaaagtagagagtcccgaaatgtagttcagttggtagagtgcttgcttatcatgtaggaaatccctagttctaatctccagcacagcataaactgggaatggtggtgcacatttgtaatcccagaagcagggaggaggaggcaggaagatcagaagttcaagttgatccttggctatatagtaagcaggtcagtctaggacactgagacactatctcaaacaaagtaaaacaaactaaataatttggaaagaggccgctgacatttagtcagaagtcaaaaggacaaagtagtttagaggcgtgttacacttggccaagtgtgcaagcacagtcagatcagctcatctgtttccctgcatgtacactgtgctgaagaagcatatgtggttacaaaggcaatcagttgcactgaacgacaggaggagtcttagattgggaaagcacaggaaaacacgttttgtgtatccactgtcagtgactacatgaagcatgatgatttttaaatgataagttagctttcaggatagtaaattggggaatggatagggaggaaagcaggtggaaaaaggttttgtttgcctaacgtgctaagaaggtcatgagggtcattctctcggctaatagatggctgactgaggcacaaagtctcaggtttaatggtctgagagggttttaaaagatagtgttgtttgttaaagtatgcatgttagtgatattagtcaatttacagaatggtgcagtcatcatcagaaactaattttagaatatttccattgcctcgtttttcaatagcccctgccccaattctcatccccgatcctatgcaacaattagtctgtgttatgagttagtatttctttagcagggcttttcaaataaactatattataaaatacattgcttctgacaccttttgcttagtgtgtcctctaggttcttcatattgtgtcatttattagagcttcattccttttaatggataaatagtattttattgttgcagtagatcatatttttcttatccactcacctggtaatgacatttggattcctttcatcatttatatattatgtaaatactgttgtggacattcatatgtctctgtaaaacatgatttaattgttttcttgaatagatgtgtataagtggaattctgggccatctgcttaagactgtgttgaactttggggttggagagatggctcagaggttaagagcacatactgctcttgcgtaagatctgaatttggttcccaacacccattatttgggcagtacacagcctgtaacctcaacttcagcaaattacatgcctctagcctctgcgggcacctgtacacatctgaacacacacaattaatgataaagtaaaaggatttgtttttacaaagattgtgttaaacataataaagctgttgaaggattttttccatactggctctatcagttgacattctcatgaagtattctctggttatttatttatttttttgatcatagcttctctgtcttttaaatgatttattataacaagtcaattgccaccaccatttataaatatgaacgaggtgtttattaacaattttgtttactgttccttctttgttactgatagtgtaagagatttgtctttcctatttagtctttgctccatcttctcttctcttctcttctcttctcttctcttctcttctcttctcttctcttctcttctctctctctctctctctctctccctccccccctctctctctgttttaccatgctgggaatggaaaccagggccctgcacaccctgggagaagtgcaaaccctaggagaagtgcatacactgggaggggtgcccagacactgtgccactccttccccaacccttgtacttgttcttcagaattgttggcaataaattaccttacttttcctggtctgacaaaatgttgatcttactttcgttcctgaaatgtcttttttttttttaaagattttatttattattttatgtaactatatggtagctgtctttacaaacaccaaaagagggcgtcatatcttactacagatggttgtgagccaccatgtagttgctgggatttgaactcaggacttcaggagagcagtcagtgctcttagcggctgagccatctcatcagccccctgaaatgtctttttactgggtgtttaattctggactgacaatagtttcagcacttgaaaaagaccatgccatttgcttcatgtgtccagatgtttagttaaagaacaatctcttgcttttgagttgtcagtgatattttgtttattcattggatgcattaaatatttttctttgttgttaatatttgaaaatgaaattattatgtagtgtggtgtggatttatttgtcctaatttgaggctcctcctctacctcctttttctcttttctttctttcttttcttttctttttttttttgtttttgtttttgtttttttgttgttgttgtttttctgagacagggtttctctgtatagccctggctgtcctggaactcactttgtagaccaggctggactcgaactcagaaatcagcctgcctctgcctcccgagtgctgggattaaaggtgtgcaccaccacgtccggctttttttctcttttcttgagacagagtctgtctatgtagctctggctggcctggaacttactgtgtgaaccaggctggcctagggcttgcagatatccacatgcctctaccttcagaatgttgagattcaaatcctgtagcaacatacccagtttcatgagttgttttcaagtaattgcgggtattctcatattaccttatgagagcctggattctctttcagctttctcttttgactgaagtctgctggctttgctcccttagggaaaggtgagctgctgtatctttatgtgttgccctgttggaggagaaagtccactttccccattgacttgattaacactcagacaggggtccttggtgctgctggatgaggtaagtatttgggcttatgtcatttgcactaaccctgaagattcctgggtgtgtgtttggcctactttttcaccagtgtgttgttgttttgtaacttcagaagtatggaagacaaagcaacaagtttggccttgctgtgaagatgaaggcagaactagagttcttttctatggtgttaacacttactatatagataatttgaccatctaaagggtttccagttagctgtttccagttttccttttctagttctttggctagaaagagctgagctgggactaaatttatatctgtctcaactactcttgctgtggttctggcttcttcaaacccaagactggggtagatgaggcaataagaaatcccggtgaggaagagggcttagaatcctcaatgatgtagccccaggtaagttttccttgctcaaataaataagccccacgcacattcatgtaagcagtctaattaaaagcagcaggttacacacatgtacacacacacacacacacacacagacaaaaggagaggagacgtttgttgggaagaaggggttcagtggtaataacagagcaatggggtgactatgatcaatattatctcactacgtagccctgacttacctgaaactcactgtgtaaagcagtcttttgaactcagagatctacatgcttctatcttctgagtgctgggattaaagtcatgcacagccacgtctgtccaaaaattatgggtttgatttgttttctaactccctaaaatagaaatctgtgactgattttttaaacagataatatcattttattttagagcaaacaatctaatattgtttagtataatcacaaatgtttgaaaccataacactctctaatgccacaacatgattatcaccccattaatgcccatgcccgctccacctctcctgtcagccgctgggaaccagaaatctactacactgtgtttcagtggatttgtgtgtcctggacagtttatagaaatagaatgacacacaggatgaagtatttctgttgggcttgttttgtgtgacacatgcttttaagattcaaaaatttgctagcatgttgttctttgaatggctgaataaaattatggttatgaataacccacattttgtttgcattcttcaattggtgactattaggttgcatctggttttccctattatgaataagaacaggaacaatacaactactgggaataatgcagcttttagtattccatacaagcacttatgagcgtgtatttgcaagtttcttacaggttacacacaagaaaaatttgccaggtctcatagaaaacctatgcatttttctctaagaagcaaagcaaccaatcttttctccataattgtacctgtctaacagctgtgtccaaagatgctagtgttccagtttcatcctcaatagttgctgttgtctgtcttattcattttgttaggtatcctgtatttagtccttattgcatcatgtatacaatggcatttcatccttctttagattttcatttccctgttgaataactaaatggaagatcctttctgtttttgaaaattatacctctctctctctctctgtctctctctctgtctctctctctctctgtgtgtgtgcgtgtgtgtctgtctgtgtgtgtgtgcttaagtgcgccacagtgtgcttgtggagatcagggagtgacttgtaggagtttgtctctcctttctgggggccaaactaagatcatcaagcttggcagcaagcacctttatccagtgagtcctcttgttggcccatttgtgtgtgtgtgtggtttgttgttgttgtttgagacagggtctcactatggagctctggctgtcctggaactatgtataccaggctggtcttgaacttacaagagatctgcctgtttctacgtcccaagctctaggattaaaggcatgaaccaccactgcctcctggtttactttattctgggggctctctctggtttgcaaatggttgctttctctgtatactcacaagtgggttcctctgtgttcacacacatttcatgactatcttcagttatttgttgtgttatagaagtagaggtggcaagaaagagggtatgcataggtttgatcagctttggggctgagttagaggtattgacatgtgtgcagctgtgtgggccagggctggcattatgcagtactctgcctgcagaagtcagccttggctgcatggattattgggcttggatccttctgtaccttgtggatgtttgaaggcacaggtgcagggttgcactggctctctggaccaaagcacccatggaggcagcagctaggctagcagtatctataagggtaagtgatttaggcatctagaaaatgagcccataggataggattgatcctgtggcagcaaaattatggcagaaataatagcttaagtggatttggggagagagataaaagaggaagttacaaagcatcattgggatagaggaatcactgcagctgctttggggcttgctaatcacaggaacagcaggtcactggctctgggtgactcctgtacttagaaacaaagacagaagagacttgacccaaagtgcagctgtggtggcagttgatagcttccgtgatagtagctgcaggcacaaggatctcaaagtctgtccacatgttttctattgctttcagtttcagtgatttctcttttctcttttccttccttccttccaaactggggatcgaacccagggccttgggtttggtaggcaagagctctaccactgggctacagcctcagcacaaagtataaggggtttgtctctctctttttgttcccagtgatttcttaaattttccttttcagtcttttctttctgctgtttgctttaggtttaatttccttaccctctccaggttgttatgatggacctttaatttgttcccctcaaatcttccttcttttgttgtatagacatttaatcctataattatctcttcaaaattcagctccagcacactgctgatgtgctgtaccttttattttcggttagttaaaacatgttaatttctcttgagacttgtgtgacccataggttatttaaaactatgttgtagagtttctaaatacttccaaattaccgactctctctttatgatttagattatgtttttggagtatgaacatagatttcacataatttctgctgctttctcaaattttattaagatatattttagagcccacatatgacacatcttagtaaatgttctctttgtgcctttcaaagcacgtgtattttgctgtggttggactcagtggttcttcaatggtaattttattatgttgattaagactactatctaatcccagcactcgggaggcagaggcaggcggatttctgagttcgaggccagcctggtctacaaagtgagtcccaggacagccagggctatacagagaaactctgtctccaaaaaccaaaaaccaaaaaaaaaaaaaaaaaaaaaaagactactatctatccaggtgttgtggagcacacctttaatcactttaagcacttcggagggagaggcaagtggatttctgtgaattcgaagccaacctggtcttcagagggagttccaagacagccaaggctactcacagaaaccttgtccagaacacacacacagagacagagagagacagagacagaagagagagagagagagagagagagagagagagaactctctttgttaccgacaggaatgtgttctctctagactacaaaactggctttgtttccttttcatttccagcagtttatcttctttggagattctttaagattccttagttattttgtaatgctattcttcatctctgataatctttgttttattttttgcctggccccgaggatgaagcccagggccttattcatgctagtcaggtgagtgctttgtactgtgcacacctcctgctctagtctgctttctattgttgcgatgaaacactgactgtcttagtcaaggcttcgcgataaaacactgtgaccaaaaagcaagttggggaggacagggtttattcagcttacacttccacattgctgttcatcaacaaaggaagtcaggacaggaactcccacagggcaggaacttggaggcaggagctgattcagaggcctggcggggcagggcgggtgggggggtgttggggtgtgtgtgtgtactgcttattaacttgttcaccaaagcttgctcaatctgctttcttttagaacccagcccagggatggcaccacccacaatgaactgagccttcctccatcaatcactaatttaataaaatgccttacagctggatcttatggaggcattttctcaatttaggttccctcctttcagatgcttctagtttgtgtgtcaaactgacacaacactagccagcacactgaccaaaaccaacttggggaggacaaggtttatttggcttacagattgcagtctatcatcaacagaagccagggtaggaaactggaggcaggaactgaaacagagagtaaggaagaatgctgcttggtggccaggcctcccctggcttgatacacagcccaggcccacctgcccaaggatgatactgtccacagtggactgagtcctcctggcaataagcaattaaggaaatgcttccagtggttccctcagtctctgctccatctttatcctgagcatcttgtaggcaggacaaattttgggtcgaaggttttgtgggtgggttggtgtccttattgctccactgggagttccgcctggctacaggaggtggccttttctggttccatatccccacttctgagagtttcagctaaggtaatcctcattgattcctcagagcctccctcatcccagatttctggcatgtccttgggatgtctatcctcccttgcctgcagatttccattcaatttcatgaccatcttagctatctctcctgtctctccccacaccacaacaccccctctattcccctcagtcccctactgcattcagttccctccttccatttgcctcttatgactgttttattcctccttctgagattcaagctttctcacttgggccttccttctttttttttttttttttttttttttttttttggntttttcgagacagggtttctctgtatagccctggctgtcctcaaagtcagaaatccgcctgcctctgcctcctgagtgctgggattaaaggtgtgtgccgccacgcccggcttgggccttccttcttgtttagcttctttgggtctgtaaattatagcatgggtatcctgaacattacagctaacatccacttatcagtgaatacataacatgcatgtccttttgggtatgagttccctcactcaggatattatttttctagttccttccatttgcctgcaaaactcttgatgtccttggttttaaaagctgagtagtgcaaatgtagtacattttctgtatccattcctctgttgaggggcatctgggttctttccagcttctggctactacaaataaggttgctatgaacatagctgagcatgtgtccttgtggtatagcaggtatacatccaggactgatatagctgggacttggggttgaactactcccagttttctgagaaactatcaaactgatttccaaaatggttgtacaagtttgaactcctaccagcaatgtggctaaagtttctttttttttttttagtataaaatagtttttatttagggcatgggggaggggagttaagagagtaacagaggcagagaaaggcagagagaaggagagagtagagaaggagaggccagccatgaccacgtggagggggaagggaatgggggagagaaggggagaaagggggcaagaggcaagggagagaagcaggagtaagagcctaaagtttcatttttagttgaaaaaaaggccacatactttttttttttttttttttggtttttcgagacagggtttctctgtgtaccctggctgtcctggaactcactctgtagaccaggctggcctcgaactcagaaatctgcctgcttctacctcccaagtgctgggattaaaggcgtgtgccaccactgcccagccctaatattctttctaattagtggtttacactgtgaattctctgtgatactttctcccttctgttatgaactggccttcgttggtgattccacagtgtgaaaatacttttgctaggtgatggtggcttgagcctttaatccctgcactcaggagacagaggcagtggggtctttgagttcaaagttccaaggcagccagaggtacacagcaaaaccctatctcaacaaacaaaacaaagcaagcaatcacagtaactttttttttttcagtttttcaagagagagtttctctgtgtaatcctggtttctttctggtatcaaaaatatgacttaaatactaatttattatcttcattttctaaaggctgggatcttaatgagcttatttttattcaacatgcattttgtaagatttacttggcatcatgactgactaaacataaataggtgatttttaaaagacattattcaaaaaaaaaaaaaaaagccgagcgtagtggtgcacgcctttaattccagcactcaggaggcagaggcaggcagatttctgagttcaaggtctacagagtgagttccaggacagccagggctatacagagaaaccttgtctcaaaaaaccaaaaaaaaaaaatcaatcaatcaatcaaaagacattattcaatctttgaagagcttattgtttagaaagattgaaaccatagccaagcagtggtggcacatgcttttaaccccagcattccggaggcagaggcaggtggatctctgtgagttcaagaccagacatgtcttcagagaaagttacaaggcaaccaggactacagagagaaaccctgtcttgaataaacaaaagacaaacaaacaaaaaaaagtagctgtgattgtttgttgcatacaaatgggaacacgagaaaacagatatattaaggaataagtaaagactttatacacacacacacacacacacacacacacacacacacacactggagatatggtcttactttggagccctgactggcctggaagtatgcatatatgtatattaggctagcatccaacgcatagaaatctgtctggatttgcctcctgagtgctaaagttaaaggtacacatcactaaacttagcctagagtatatatttaatacagctaagtttattggctcagaatttgacctttgaggagcaccagagtttagtgagaattaataaaaggacctttaaagtaaatattttagttgctttatatgaaaaaaaaggcaaacccctcaagatcacatttttttgtggaataataaaagcaacatttattatttttataaaagtatgaacatgaatatagtgatatttatcttaaattctccaaaatcacctatttttcttgtgatccacacataatttatctaaataaattggattgtgttttattagtgtttgttttgttttttgctttttcagtacagggtttctctgtgtagccttggctgtcctagaacttgctctatagaccacaggggcttccaactaagagagattgaccagcccctaccacctgggattaaaggaagattagccactgcattaactaccaccacattaaccaccacaatatttgagccaaatttgaagaaagctttaattaaataccagtcaggatttgaagcttaactttaattaaataccagcctggaggatggactctggccagatcaattcctgggttcccagaaagtgaccaggagttacatcttgcaaaggcttaaaaagacaaccccacaaggccaccatatttcccacctacacccaatcaggggcaagcatacatcctgacatacttcttgcccaaatacctgttacctacatgagatcaaacacatctgtgtagttgggtcaaacaaacttgtttaaaagagtgaaacaatagcctctagtatttcaggaagtatctgtccttgggtaagcgggtttacaggttaagaattttgtttcaaggatctcttaggcacagtaattaaaacacccatacacataaaaataaataaattaaaaatctatcaatagtgaaattgttaaatcaaaatcattaatgcagttataacgtttgtatagaaattattaaacatatttgacacattattcaagaatacagtgcctggttaactatagtcaactattttccaatagatctcttcatttgtgcatgctactgaactgaaatagtctacctttaaccaacatttcctcaccttacccttaagcacttgataaacactattctactctagttctgtgagatcagctttattagattccacatataagtgaaacatgtgtgacatctgtctttctgcggggtttattaatataatgtcctccagattcttacaactaaccaaaataatgtgatttccttcttcttcttcttcttcttcttcttcttcttcttcttcttcttcttcttcttcttcttcttctttttgtttgtttgtttgtttgtttgtttgtttgagacagggtttctctgtatagtcctggctgtcctgaagtcctggaactcactctgtagaccaggctaccttgaactcagaaatccgcctgcctctgcctcccaagtgctgggattaaaggcgtgcgccaccaccacccggcgtgatttccttcttaattatggttgaacaatattccattgcaaactctacagtcatgtctttctccctttctttctttctttctttctttctttctttctttctttctttctttctttcttccttccttccttccttccttccttccttccttccttccttccttccttccttcctttctttctttcttccttccttccttccttccttccttccttccttccttccttcctttctttctttctttctttctttctttctttctttctttctttctttctctctaagacaatgtttctatgtgctgatctggctgtcctaggcctagctctgtagaccaggctggcttcaaaatcaaagagaaccactactgcttactgggtgctggaattaaaggcatgctccacggtacccaacaaaccccattttcttttgttatgcatgcactgactgccttagtatttctgtgtttccttctagactgctttgcataaaggatgttccaatttacattcttagattatgcaaaggctttgtttcacatcctggccaatacttagcttttctcttttcttttctttttttcttctccaccccccactccccaaccgcagacaggatttctctctgtagccctggctgtcctgaaacttactctgtagaccaggctggcctagatctcagaaatcctgcttttgctgcctgccaagtaacttttgtcttttctataatcatcctagcaggcataaggaagtgtcttacagtggtttcagtttgcatttccctggtgatgagtggcttagtttcttttcctgtcactgtgataaaatattctgatgaaagaaacttaaaagaacagctttatttacttcacagttcaagacacagctcttccgggtggggaagtcaagaaggcagaagcttgaagcaggtagccatatcacagtcacagatcagaaagcagagaatgatcagcaggccaatgcttagctttcctttttcattctgtactttccaggcttccttatccaggaaattgttctgcctgaaattaagatgggtcttacaggccgggcgtggtggcgcaaagaaaaataggctacacagagaaaccctgtctcgaaaaacaaaaaacaaaacaaaacaaaataaaataaaataaaaaaagaaagaaagaaaaccaggcatggtcaggtgtttctaggttgacaaccattagtcatgctaagcatgttttcatatatctgatatagctgaatgtataataatatcattcatatatatatatatatatatatatatatatatatatgtgcaattattttctcccattctgtacattgtctcatcacacttgatttttttcaaaagtttattatgtttgatgtgaaaatcacttgttttttttccttgtccatgtttttcatgtcatagccccaaagtctttactcagactggtatcagagagtttgtctccatgtattactgcattagttactttgctatcactgttgtgatgcatcatgatgaggtaacttctggaaaacaggctttatttggtcttatatttccagaggcttagaggccctgatgtagagcggaggcagtgggccgtagacaaggcagctggagcagaagcattttccaaatcacaagcagtaagcagagaaggaaccaaacatggtgcaaatctttaaactcttaaagcccaccttcaggcacatatgtcctccatccaggccatacctcctgaaccttccaaaacagttccaccaacctgggaccagtactcaaatgctgagactgtggtatatatctctaatctcagcacttgagagacaaggatcatgaatactgccacaagtttgaggccaacctggcccacatagtgagttctaggccaggcaaagatgtaaagtaagaccatggctccaaaaataactaaataaaataaaaaatgtttactagtatattatattttttaatgcgtagatctacatatctttggttaaaattatttctaagtatgttcacaactgtaagtgagattgcttctgtgaaatctttcatcaattatttcctattagcatgtcaacttattattgacttttgcatattgattttgtgtcctgtcattttccttctcagatctaacagcttctggtcttctgaaagattataagataatgttatctggaaacaaggaaaattttaacttattttttcaacttctgtcataacaaaatatgggttaagccacaatcactatgacacaagccaagatcctattcttcatcaatgtgatgaaggaaagaaacactaaaagaacagtacagatgagtaggaaaggctggtttcttaatttattcctaaaaggaggtcaaatggatgcatgtgttcagatttcacattaaattgagcatctgggactagaactggaacatttcactacatggtattaacacattaaatgcatgtggtgatagagactaggattatgatcctttaaaaatagtgttatcgctgggcatggtgacacacgcctttaatcccagcactcaggaggcagaggtaggcagatttctgagttagaggccagcctggtctacagagtgagttccaggacagccagggctacacagagaaaccctggcttgaaaaactgaaaaaaaaaatagtgttgtcaaccagacaataaggtgctctacagtatatgtttaggttactcatcacttactatataggtagcaattttaaaacaaaaaaaggaaggcaaatgaactccaacttttttcaatttctctgttataatcaataagaaaacaaacaccagggctagtaagatggttccgcgggtaagagcactgactgctcttctgaaggttgtgagttcaaatcccagcaaccacatggtagctcacaaccaccggtaatgagatctgacaccctcttctggtgcatctgaagacagctacagtgtacttatatataataataaataaatcttaaaaaaaaagaaaagaatccagcacttgggagacagaggcaggcagatttctgagttcaaggccagcctggtctacagtgagagttccaggacagccagggctacacagagaaaccctgtctcaaaaaaaaaaaaaaaaaaaaaaaaaaaaaaaaaagaaaagaaaagaaaacaaacacaaatttggttctatgtgaacatttcaaaatatagcattgaacaagaggaccaagaccaaaaatgtgtgtcagaaattcaactgtggccgggcgtggtggcgcacgcctttgatcccagcactcgggaggcagaggcaggcggatttctgggttcgaggccagcctggtttacaaagtgagttccaggacagccagggctatacagagaaaccctgtctcaaaaaaacaaaaaaaaaaaacaaaaaaaaaaaagaaaagaaaagaaaagaaaagaaaagaaaaaagaaaaaaagaaagaaattcaactgtgggccaggcagtggtggcacacgactttaatcccagcactcgggaggcagaggcaggtgaatttctgagttcgaggccagcctggtctacagagtgagttccaggacagccagggctatacagagaaaccctgtctcaaaaaaaaaaaaaaaaacccaaaaatcaaacaacaacaacaacagaaaagaaattcaagtgtgagcattggcccctttgcacagctttctagggttaataaggagaagctgcaccagcagcaggatttcagtaattaaggaaagctcttctcatctagaggtctgtctataggccaacactgatttgtacaaatcttttttttttttgttttttttttgttttttgtttttctgcctgcctctgcctcctctgcctcctctgcctcagcctctgcctccagtgctgggattaaaggcgtgtgctaccatgcctgcttacaaatcttttagtagatgagctccatgcacaggacaggaacatgtcagaatggatgaatgatctgtatactatataatttttgtcactcgtatttatagagtgcctgaataccaagtagtaattaaattactcttctgtactttccacaacttcatttacagcatattccttatgaactgcttcccctagatttttcataattagtgtcatcttttgaatacagttcatagtccctggcagaaagacaaaggagctatttttgcctgataataaatacccaataatcaacaagcccaagtttagctcttcagaactctttaagttccactttttccaagattcttcccttgttttttgttttttctgttttttttagatttaattaatttattttatgtatatgagtacactgtagctgtacagatggttgtgagccatcatgtggttgctgggatttgaaatcaggacctctggaagaacagtcagtactcttaacctctgagccatctctctagcccccttgttttattttttaaattttattttcaacaacttcataatgcacataagatactgggatcatatctatcctctcttaatcccccctctcctatagactcctttctcttccaaactggttcctgtcttaattttctctctttctctccctccctcccttcctatttttcttcacttacctcgtccttgtttcctcctcctccatcttcttggtttttttttttttttttgagacagggtttctctgtgtagccctggctgtcctggaactcactctgtagaccaggctggccttgaactcagaaatctgcctgcctcttcttcctaagtgctgggattaaaggcgatcgccaccatgccagactaattttacttattttaaaaactctttttgctccccttccttttctctctcttgctctggtcctgcttgctccaggccctgcttgctcctcctctgccccctacactcattatgctcattatggctcataggtttttgttgttgtttgtttctcattatggatggtggtgagccaccatgtggttgctgggatttgaactcatgacctcagtcagtgctcttaaccgctgagccatctcaccagcccttaaaaacttttttttttaaatgaatgaggcaatttattaacccagcattgtttgttttaatgctttttgttggcagttgctacctgtccagcgatcctgtccagatgtctctgtccctgatgtgttagcttgcagtccccatctcggccattttcagcccctccagggcttggaggacctggctggccacactctcagagcctctgcttaagtggctgggcctaacaccatttctctgccatcctctgtagatcttggtcacagaaccaacccctgcaccaccgcggaggtacaggtgccgagctgtggaagcatttcgtgggtagaaccagttctcatcatatgggcaagctctttatgtttggccagctttactgtgtccacacattccgggactctcagtttcctggactttttgaggaaggctgctagagctctgacgatctcctgctggttaaagtcttttacagtaactccaggaatctctctgctgcctgggctctggaattgtggcgatcagccatgtccgggcctgcctctcacacgtggccccttaaaaactcttaaaataaatttgcctacatttgtctgtgcatcacacatgtgtctggtgcccatgtagaccagaaaagggcatcagatcccctgaaactttagttgtagatggttgtgatctgatatcatgtgagtgctgagaaccaaacccaggttctttttttatttttaaagattttatttattattttatgtaaatacactgtagctgtcttcacacactccagaagagggagtcagatctcgttacggatggttgctgggatttgaactctggaccttcggaagagcagtcgggtgctcttacccactgagccatctcaccagccccaaacccaggctctttgcaagaacaggcagtgcttttaactgccgagctatgtctcctggccaacgtcttatttttgtgctgggcttctgaaggtcaccatgcttacctgctgtgttcatggttaactgaccatatcatatccaggaggccatgtttcatcaaattcctccccatcctccagctcttataatgattcttcctctttttccttgatgccccttgaatctttgaaagaatgatatagccgggcgtggtggcacacacctttaatcccagcactcgggaggcagaggcaggcggatttctgagttcgaggccagcctggtctacagagtgagttccaggacagccagggctatacagaggaaccctgcgtcaaaaacaaacaaacaaccatcagggctgggtgtcatggtgcacatctttaatttcagcatttctgattggctagacagactgcccaatctgac

SEQ ID NO: 52 - DNA, 214384 bp, Mus musculus; identical to SEQ ID NO: 48

What is claimed is:

1. An isolated stem cell comprising an Xic flanking region transgene having a polynucleotide sequence at least 95% identical to the polynucleotide sequence of SEQ ID NO: 47, or a fragment thereof encoding a protein that prevents the stem cells from undergoing X chromosome inactivation and from differentiating in culture, wherein expression of the flanking region transgene inhibits the stem cell from undergoing X chromosome inactivation and differentiation in culture.

2. The cell of claim 1, wherein said Xic flanking region transgene is expressed in said stem cell.

3. The cell of claim 1, wherein said stem cell is an embryonic stem cell.

4. The cell of claim 3, wherein said embryonic stem cell is female or male.

5. The cell of claim 3, wherein said embryonic stem cell is mammalian.

6. The cell of claim 3, wherein said embryonic stem cell is human.

7. The cell of claim 3, wherein said embryonic stem cell is mouse.

8. The cell of claim 3, wherein said embryonic stem cell is from an agricultural animal.

9. The cell of claim 1, wherein said Xic flanking region transgene further comprises a selectable marker.

10. The cell of claim 1, wherein said Xic flanking region transgene is flanked by LoxP or FRT sequences.

11. The cell of claim 1, wherein said stem cell further comprises a heterologous recombinase.

12. The cell of claim 1, wherein said stem cell further comprises a second transgene.

* * * * *